United States Patent 9,567,581 (SELECTIVE REACTIVATION OF GENES ON THE INACTIVE X CHROMOSOME) - sequence listing, part 15

SEQ ID NO: 1195 - DNA, 123993 bp, mus musculus
agcctctggcgcgcccccggcggcctgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctagtgagtaccgtgccctccgccgccctctcccttgcgctcgggatggggctcagagttgaggcaaagtgcgagtccgcctcccggccggcggatgcccctgccctctcgctgcccgggtccccggagctactcaactgaactaagggcaccctgcgctttttgccctccgaggcaggcaccccacacttggagcagggtgctgctgcaaggaatggccccgtggctcctagaggtgttagctttctctttgcgatgacttcgaggagttttgactcctttacttgtctccttcaccacccccaccacccctcaccctgccccggttttggagatctgggttactcaaggtgttgacctctcctcactttggtttccattaccccaagtgaaagccccgccagtattcccgccccgcgtatcttgcacatggagaactactatcccattgcaggatgaaaaatagcaactatccaacttctgttagtgatggaacttagctctggagcttgtgaggttacccatcttctcctctgggttttcttgtgccctgggaaggggggaggtttcttaaaacacatttttcccttactacttatttttatccaaatacacccattaaaatgtgtttctcgtgtagcgagcgcactgccggcttcctcacatttgaagagtgcgaccttttttttttttttttccattccaccgtctggataatagctcattcaaagagaactgtccccacagagccacggtcagtttgtacattaagcgtgcattcgcttttgtgtcgatttcactttttaagaaatccatgttatacttgatgatttgagaacagttaaatagtaaatgtgtaggaattgttatggtttcctttggttttgtatcttaaattattttacccttcaagtgtgtggttgaaaaattttaaaatagcactgttacagctaaaagccaggttaattctaatccctgtccatttggatgtgtgggaggtggggcatatggttttttttttttaatgtgtaaactgaatgtaaactgactttttgcgttaaatgctagacagaatgtaaagaccaagagagggcagaatgagaaaaagtgcaattgcttttatttgagtacttagcatcaacaagaaaaataatacagaaaaaatttcagtgaaactcgtactgaaaggcatcagccccttttccagctaagacaagtgccccttgtcccccatatcataaatacctgaattgatgttcttttaaaactgctccttttcattttgtgagattagaggattggactactgttgtataagtataaacatttctgcctagactaaaatattaaattaatatgtaaagtggaaattacaataaagtgtcctggaaattgtgcatttgtactgtttgttttctttggctttcattctttaaatgtctttaattttgtatgactcttctgtggtctgtgcattttcttttagacttggttaatctttgggcattggtttatgagaagtgcatgaaagagcatccaggagaacacttcgtcaaataaatatctttataaatttcatagtgttaattctagaagcttaaatcctaagtccacacttttatttagccaattcatttttttggttaagaagtaaaattcattttgaaaagactgccatgtaaaataaatctatgaaatatttattagcttgagtcacttatttgtgacttttatgccttctcttggatgtctgtgatgtattaaagctagtcctgggatgatacttaggttggctctgcaaagtcatgggactgcaaaaattcactcctgtttagttcttgagctgttaacatgagtttggcaaaggctgctttagtattcacgctccattgctccaaagcatatgagaacacactttcaggaggtgctattttcacacattttacagtgagtttgggttaactcaatgactataacaagaattttaaaaggaaagtgagcttgaccagttcatacagaaaatgcttttgaaaatatcattttaacagtagccactttgcacacgtatttagatattattctattcaaacaccccagcccctggatttctttttcatggaattaagcagatgataggacacactttgaccactgtggatatgttgaaacggtggtggaagaataataactattatcatctagcagaccttgaatgtgtcatgtattctataaaacaactaatgtagagtagacactaaacatgaccaagtggagaatgaaagttcacttaagtggaaaatggactgtcttatttccatttatcttcaactcatttttgaggtgtactgtggaaaattcaggaaaacttcctgattatgggagggacataactaagcatttcaacagtgccttagtaactaccacacatttgtctttctgttttacatatttaacagcattgtgtacttattagtgttgctttatcctaagtgccataagacataaacagacatattgggatttttttttctcatagttattatcatgtcatgagcagtgtgtttcaggtcatgtctctgcccaccagatgttgtgcttttgacagttttaacttctcatacgtaaacgcacactcttttcatcctttcccaggacttttctctcagaatgtctgtaactggtgaaatcctcgttttatgggtttagaagctgtagatccatcagttagttatccttccactcagtattgaggggatgtcaatatatgaacaagctgtatggatacaaattcttcactgttgcccccatgttttgattacctacccaattgcagaaagcattgtacaggcaagtttgtgcacagaaatctggttaaagacatgaggaaaacttaactttactgcattttgatattcaaaatcagcactcttggatttatgtagggagcccagatagctattttataggaacctgtttgctactataaagggatccactgtgccaggtgttgagctagttagactccagagcagtcattcttaactttggctgcacattggaatcactgggaagttattaaaaatatggatgcctgagccccaactccagagattctaatttaattggacttgaatggggtcttggatggggcctgggaatcaggattagtaaaagctcaccaggtgagtttaatgtgcagccaaggtggcgaaccactggttatagtctactgaatctttctcttgagatttggataatttgggctagggtagtgccttggaatctgaattttatgagcaccctaaatttcagtaaacaaccgatttgagaaactcttgcattgtggtctgcagaagacatcacctgggaaatcattacaaatataggctctcaggccccgcctcagacctgctgaattagagtctgcagtttaacaagctcctcaggtgattcttacgcacattaaagtttgagaaggactggttctcatactttggagtacatcataatctatagtgcttgttaaaacacaaattgttgggccccattcccggagtttctgattcagttggtgtggggtgggactgtgaatttgcatttctaacaagttccctggtgatgctgatgctacagttcccagggccacacgttgagaacctctggagagagaattgaggacctgaataagtacttgagcgactgtaatggaatggcaattttcaaggccagttttcagtataaaacttcctgcttctgtgtcactatgctttagcatgttcattctaacctagcacccaggagattgagtgctgccgagagtataagagtctgaggttcttgggatggttttagttgaggggtgagggtgactcttggaaacctgtggtatgattttaggtcctttttcagaaattgttaaatgtaagggatacattttaggagttaaaagcattacaaatatgataccttaaggtgaattatattgattttaataagtaaagccccctttgttcccataaaatgctcttatgattctttcactaaagtattgtgaaaagattttaaaagcttttacttatgcctatggttgctggatttcattttaagactttccctctgtaacaaaaatatgaaaggattctgctaaggcactgggattgttcagtcttatatctttaatgctgctgcgtgtcacgttacttgaactttttattttaatcatcctaccacctttgaagttaacgtaatactacattttgtatagaccatagcacatagaagattctttattattaaagtacatcagtaagtgtggttttaaattgcaattaataaaatgtattttaaaaaaatccactcccgcatatgcagattttgagactctgaagaggtgttttaacagttaactctttctcgtcttgccaccgtagtcaagttgctgtttttcagtgtgcttgggaggaattgggttgtgttggggagtaggcattttgtttcaacagaactgtggcaatcctattgcattatcaaaaagatgatttgatagtgctgctcaggttaaaatgatattaaatttgtattttaaatataagccattatatttctgttatatgttttctgatgaagattgaccagaatagccagaagatgtatctgtctatcgcagatgatgccatgaggccatgacagatttccttatccacactaacataacggtactaacttgcattctctggtcataatgtatagtttttcttataaaagcaaaacactgtctgaacaattgagtcattttgaaggtataatatggttgtttttttttaacaatgttgattcccattggaagacaatctgatgtcgtatcttatggatagaaaagaaggcaggcatgtccccagttgtcagttgttctgtaaaagccatcagtgactgagctagaaggatggagaaatataaatcacaaaattgtttttatatccatgcataaaggtgtatgtgggacaaggtatatttagttaaaaagaaaatgcttattttgctttctcccccatatggccaaagggagtgataatttagcccataatttttcttgcttatgaattatgtttgtgctatactcaggtttcagttagcgggtggcagccaagtaggaatctctgctgaaatctctcagtccaatgggaagaaagaccactactgaaaaagtaaaaaatggtctgttaacccatgcatgagttgtttttctaagtatgtatttctcaggcacatgctaacatgtgtgttgttgtctttttaaaaactgtatgctttttgaaaccaaatttgtgttataaatactaaaaccttagctgtagtggattatatttttgaagtgaattgcatttcctatttatagacagttttactttttgagaatttatgtgtgaaacactaaaacttgtgtaatgagattagtcagttcccaagttttcctgatttcaataggcattattatgtactctcgatgtcacacatgcttggctcttataaagcagcacaatgaccagggcttttacatttaaattttgttaaatagtctctttttcaaacttgtgtaataatgtctctttttgatactgttctgaatcaattaagctaagtaagtgaggaccagcagtaaaacccagcatctgccaagaatggaccctcaatgtgtaagctgtctttccacaatcagtaattgggcagttgctcacaggacactggagacagtgtgggaaaccagtggttgtgtaggtggaaagagtagattcccaacagtaagcttatttagagtttagcttctgtagttagtgttgctaagagcaaaaatgacccacagtttatgtagtataaagaaaataacccaaaggaagaagtacagtgtaatagtatagttggttgggtggagcatgttttatgttcagtccaactataagtggcatcttttgtatcaagtgtgggtgtattttctacagctcttaatgtttcagacattgaaacttgctcaaagttaaaaatgttagtgttgaatagctgagtggaaattatatgtcattggaaaaaaaaaccctgtttttgtaaaaaatatacattatcctgagtttcatggttggaaaccagaaaaatagaaggaatagtcctatcctcacagagcttacagtcctgttcaagatatgatactattatcaaagttgcttgaaatacttacaaagcaatatatacatgattgtagattaataaaatacacataaaatgcatacacatggaaatgacatggaataaaggagtggtcagggagaaggctatagggagggaataactggaaccaagttttgaaatggaggaggtacagaaattattggtagagtctgtttgaccagtagatcttgaagtcttacttggttgttcttaaacccgttgctgtcaccaccacaccccttgccacagtacttggggattcccagcagctgtcttcagtcagcaacttgcactctcagcattcttcatatcactccccttgctctggtctctaagatcataaaacttcaaggaaattaaaagtggcctttgtgttgagaatcctctggggaggctggataagagatcttgtatctgcttatagtttcttgtattaggaagagaacaggatttgcagaagagtcctctagagtatcagatgaattgggagaagagtctcaagataggggagactaactaggcttaaggttatgagggcagtaggaaaactggcattggaaagtgggaaagccaccccaggggcagagtttgtgaatataggaatgttgcaaaattgagaattggaagaagttatcagcatatgcaagggttcatactctagggccaggttttgtgtaggagtggaaagattgtagctcacctgtttttggcttccatcattgcctcttcttttcttggctctgtgcctagctattcttgtgctcagaaaaagtttgttaaacagctctgttgaaatggctatgaaatttgatcacaggcataagaactctcctcccctttccctcttcacctattcccagctgtatctaatttgggagaaaggatgagaggacacatcggtttatagaatttgtatcaaatataaagatagctggaatagcttttggatgaggacctgtgattaggtgactacatgtgcatggagaggcactgcaggaaaaaaaaaaacaaattctggttgcttggcagaagtaaaagaagagaggctttgaacatgattcagagttcataagcctggggaaccatgaggatggtggtgccattaaaaaacatggggggaatatgggaagaaacaaatggttgggcaggtgaaatcagatttcttactatgtgtagttccaagtgttggcagttatcaaatgttatttctttttgaattaccagaaccacagagcagcaacagagctattgtgatgttttagttggccccttgggatcactcccccactttgtgactttgaatggctcagataagtagatatcagtgatagttttcagctttgtactgctagtaaaaatacctggcagaattttgggtttctttaatgtaggtttttacattttcttagtcttcaggcttatcaatttgtaaagcaggcagtgatccttttatttccttatgtgtatatcatagtacagccttgagcaagataaagcctcgtggcaggccatctcaggaattcataatttcagaactaaagggaaatttttgaaggactagaagtgcctttggtacaagattctaggttgtgtgtcctaaagcttagaaagtaaaatagattgaatcaagctggatctgttttgtggctttgctcaatgatgaaggatggatgttatgaactgatgggatcagccatattgctttaggatctttgcgatcttcagtggatgggcaaaagtgaaaagttctgcttgagtaaagacctactaatactagtttttttcaataaagtctgtgatagtcttgatgattcttgccttttccctatctgtttcattttacagataatccacattgttacccaaagccacatgcagtgccgggagagcacagttgactgttttatgcagtatcctgccagaagatgctgaccagttctctagtaatagaaagtagtgagattgaattaagagcctatatagttcaccttgccattcgatatactttcactgtgatctgtaagcatattacatacaactttagtaacatattttctagtgagatcttggattgctgcaaggtggtaacagattctctgctttgcttcaggtgttagtggatctttgagtaattcctatggaatggagtctctgaaaaattggttttgatgctgttagcctaggggtcccacagcactgtatctgcctcaaataaatgcttatgtactagttacattagtgtgtttcttttctgtgatatcattatcgcttatagtagcctagcaaccacacggttaggtttaggtggtttggggtgcaaataaattatatagctggtaaaacttgggcctcagtacataattcattgtagcaaggcaaacactttgtgctgattttgaacaaaagtgaagtgtttagattgacgggtgcttttttacctccttttttatatggtaagtagaagatggcattggtgatttattcaataaagaagaatctcatgaagtctttgccttttttccatgttagagtaggtattctcaacacaattcatgtgttctcaacacaattcatgagtttccctatgataatgacaaaaacaaattaaaaaaaaaacttgccacagcttcttttgcattaaaacaaaacaagccaataaaaaacttgccactagcttggctgggtacttgattttgtggaatagctctttgatgttaggagtaggtacagagaaagtcagtagttaaaattttttttgagttcacagatccatctacccccacactcttctacttgtccattcaaaaaaccctcacaagaacaaaaaggaataatattctatttttccgacactaatgaggtgggtgatatgtggtttgtggtatactttactccacaaactcctccaactattgtcctgtctggcaatttttgtgggaattgactctcccacattgtaggcattggctgtgtggagaaagagagtcacatgtggttcgaggcagggacagagggcatataggaatcagggagggagtaaaatgaattgtattcaagttaagtgaagcatggattcagggcagaaaagggagattgagcacctgatctggagcaggagtgctttttatgttttacatcataaaaacttagatgtccctcctttagaatcaatggccacagcattcttgttaaaaaataattattctggctaggtgccatggctcacgcctgtaatcccaacactttgagaggctgaggcaggaggattgcttgaacccaggagttctagaccagcctagacaacatagtgagacccccatctctacaaattatatatttgaaaaacttagctgagcatgatggcatgcgcctgtagtcccagctacttgggaggctgaggcaggaggattgcttgaacccaggaggtcgagggtgcagtgagccgtgatcacaccactgcactccagcttgggcgacagagtcagaccatgtctcaaaaaaaaaaaaaaaaaaaaaaagaaaaaaaaaagtttctagcagaagcaaatgcatatcatgaagtttcataatatgaggacctgctatgggtccttttaatacttataagagaccatattgaaaaccatttgtacagtgtcttcagaatgaggcctctacataactctggaagctatgggacaagtagctttacccaaaacagcataaatgtagccactctcctgtaattatccttacttatttttcttgacttgtctatgcacatagctataaatcctcaggtattcagacatatcttctttttaggcctgtatatttatattaatagcctctacttagatgtgtgaagtttgtttcatgtagtttgctcacagttattatctataacaaagattatggaacaggcactattaaatgatagacccaggtataatttctgactggctgcagaatacagtcatacaaaggtacatacctatctcttttgtactttatcttagaaggacctactatggtcaatttaatttgtaaattacattctcacagataactggagtgtcagccattttttgtttatcagtttatcttttatcatatacatgtaggctgatggtagtttactttttttttttttttttggagacagaatcttgctccatcacccaggctagagtgcaatggtatgatttcggctcactgcaacctccgcctcccgggttcaagtgatttctcccgcctcagcctcccaagtagctggaattacaggcacctgccatcatgcccagctaatttttgtatttttgtatttttgtagagacggggtttcaccatgtttgccaggctggtcttgaacacctgacctcaggtgatctgcccgcctctgcctactgaagtgctgggcttacaagtgtgagccaccgtgcccagccacttattttttatggtggtaaaaaagatgagatttttaccctgttagtaaatgtttaagtgtatagtaatgttaactataagcactctgcttagcttaatttttaaaggcacataatagtggctttacctaaagcaactcatttcttctaggaattttgggaatccttcacaaattaaccttataaacttactagaggggccaggcgcggtggctcacgcctgtgatcccagcactttgggaagccaaggcgggcggatcacctgaggtagggagtttgagactggcctgaccaatatggagaaaccccgtctctactaaaaatacaaaattagctgggtgtggtggtgcatgcctgtaatcccagctactccggaggctgaggtaggagaatcgcttgaacccaggagtcaaaggttgctgtgagctgagatcacgccattgcactccagcctaggcaacaagactgaaactccgtctcaaaaataaaaaataaaaaaaataaaagtaccagaggtgcatagctcctttttacaagagagcctaatttaggcttcgaggtatttatttttccaaacctattgaaaattatgaataaactaaaggcattaaaatcaaaagtaactttttaatttttttattttttattttattttatttttcgagacggagtcttgctctgttggccaggctggagtgcagtggcgtgatcttggctcactgcaagctctgcctccgggttcacaccattctcctgcctcagcctcccgagtagctagctgggaccacaggtgcccgccaccaagcccggctaatttcttttttgtttgtttgtttttagtagagacggggtttcaccgtgttagccaggatggtctcgatctcctgacctcgtgatccgcctgcctcggcctcccaaagtgctgggattacaggcgtgagccaccgcgcctcgcccaattttttacttttttgagatggagtcttgctctgtcacccaggctggagtgcagtggtgtgatcttggctcactgaaagctccacctcacgggttcaagtgattctcctgtctcaacctcccgagttgctgtgattacaggtgtgtgccaccatgcccagctgattttttttttttaattttcagtagagatggggtttctgaggaaatgtgttttctagagagatggaaaattggaagataaattgcataatgggatattataagtaaggccgttaagtctatatgtgtatatatagactatataaccatttcagttaagcacttcttgaaattgcttcttacagtatacacacttgtttctaatgaaaaacttacatctaagtgtggcagtggcatctgtgaaataatagatatgatcaagttgcaggtcttgaaagttgtttgtttgccctgttttctgtacaaccagtatgaggctctctatcattagctggggtgtagacgttttaaaaataatatcactgaattgtaatgcatcaatttgggttttggagcagtatctaacttgttccatttagaggtggctttgcagttctaaacaagaaagtagaatttttactatgattatccctttgcttacaggcttttaaaatgaatatttgttgaagtctcaagtcttttttgccagtattatcttaagactgtgtttgacatcaatacctatctcttattctatgcaagtactgctcttaatattatgactggttctaatatttcatttcaacaagtaatacagctgttctgggtagaacactatgctagacccctttatgagtatgggtgagaaatctataaaataggcataaaccatgcttcatgtccttaaaaagcttgcagtcatactgaaaagacaagattcatgaaacaaataatgaagtcacatatgattcaacagctaaatgagtgatggagacagtgatgtctgtaggactcattgtttgggtagactaatgtgggctaagattgtacaggagagctttacagacaaaataggatttaggctaggtagaactttcatagatggaaaaagcagtctaggcagagaaacatcttagacataggtcaggatgagcattatacagtggtcagtgggtaccaatcaaaagtaggttgaagtgggggagaacctagcaagaaaggggacctgtaaggagactagctataacaagcattgggaaatgaaggtctaacagttgacaattttaaaattttaatggcctgtgagtggcctctttcttggtaaaatttctctttgtctgtttaattatgtctcaccagcacctttaatgttgtgaatgtcatgaaaccttgacaagagactaggaaataacacaagcagtagtctgctctgtagacaaagtgctttcattcttcagtacgcattcagcttaagtcagttagattaacattggttatgtcacactgcctgagtgccttctatgttcagtgatcttttttcttctgaacttcagtgtctcaaagatgaagttagaaaaattgtctagctacaaagttatgtagtttaaaaatactataattatgatacaattaaatggtttggtcactttctttcctcctaaagttaatgaagaaattttacttggatattgcaaatttaactgagataatttaggtactagggattataataattttaggaagattgtgaatgatgacagtcttctttatgaaattaatttaaacatagattaggctaatgggaatgttccttatggttcttcacatgagctttaagaatgctacaactcttaagaaacaatctatataagcaaacttgtaaaggttttatactgttatttagaaacaaaattctaaaatagtttcctgaattacaatgagcagcatatttttagtttatgttgaggaatgattatgctttgaagaaaaaaacaagcaaaattctcagtattttagctgaagatgtgtctttaagacataagtttagaacttaaacttctttttcagtgatcactgtaaaattctattttagtaactcccttctgttattcccagaatatgttttagaatataagaaaattattttccaaatatgggactaatctctggcagattgtaaagcatgagcattgtatcagtatactcaggaaacagaaaacaacactagcgtaatgctcactaacagtgttctctatgtagtcagtttatgtctataagtaaatgaactctccctcctatcatagtcgaatctgcaatttgaattatatactattagagtgaggagaaaaaataccagatgttaaaatagtggtagtacaatatttttgaataaaagttgttgaagaggtagatgttgaccctatgtaataatcatagactcctgccacataatgggataggaggccaaatggaatccagtggtttttagtacagaccacacagaggttcctgatcacttttaatatccgtaaatctttcttaacaaaggtggatgccctcatcaggggagtgggaggcaattttgtttatacagggttgaactatttagatttcaacttcatttttcacagacttcaaacaacgtgcatctcaaataggcaggcacctccatagtgtagagcacaactgggggaaaaagtcagggcttttctgttttgattgtggcaagagaacaagcaaacccattttaaagtgaaaaaaatggatgtaggtctaacgggccctgattcctgtctccattgggctacacatagaacctttgcttctgtttatttccgctcagtctagagaaattcagataagttcttacagaagaggagtgctttagtctttaaggtttctttcactttcattaagttatattcaccatctcataataacccttcattaactcttaactaatttaaatagtttgtaccagtccagcacggcctcaggtccattcattttctcagaattgttatatttaaacactttttacttcaatctctcccaccccaaatttgaagtataaatttaggaaaatcagtcaatctctctctctcttttttttttgttttttgatttgtttatttatttttttggagaccaagtcttgctctgtcgcctagactggagtgcaatggcgtgatctcggctcactgcaacctctgccttctgggttcaagcaattctcctgcctcagcctcccaagtagctggggattacaggtgactgctaccacgcctggctaatttttgtatttttagtagagatggggtttcaccatgttggacaggctggtcttgaactcttgacctcaggtgatccacccacttcggcctcccaaagtgctgggattacagtcgtgagtcaccgcgcctggcctaggaaaattctcctcttaccccttcttcaatatagtttctctctggagctttgccattttcaagagcagtaatcttgaatatttgaaagcttggtagcaccttcattatagaatttttactgtgtaaattctagcaatgtttatcactagcaaagttctttactggtcctgctggttttccatttttgggagatggtagaatgatgggaatggggaggtgtaaatttatgacttccaagtttttttttcaatcattggatttgagtgtctacagcagtgtataaacactgtctaactgggtgaattttggaatcagggcagtacaaatctaaaaagtttctagaattttttccagggtgattttaaagcagagaataaatgagatgtcccattgtaccccttcctcctgtgctttacctgaaagaaggtatctttttctcttatgcatataactgaaaccataagatcattgtggatttatttgatattattgttagttagagactgacctggttatatgtagctgtattcaagatggtaggactatgtgcttatggttttcagtgaagtatggcacaggcttatcttttactctatgattccattcccatggaagattggaatgcttgaaaaattatttggcactatttctttcttctttttctactgttttgttttaaattgtaggtttcaaaatgtttaaataaaattttttttctaatatgtttaaagtcatggatttttgatttagtgtctaagaatggattttagggggttggcagacataatgaaatttcatgcaaagatttgtataagtgcatttttctgattagaagtttcatatctttcatcaggtttccatagaagcttcctatagtgccagcttcttaagaatattcaaggagtttcaactaacattggctgggaaagtacaagtcggcttcacaacacccctgaaatctatccttggactctagactaggacctcctaatggactctagattaagaccccctgcaagctcctcaaatatcttatccccagatatttgtcactatttgacctgtctggcagctccttgggaaggccccattcaccaggcttgtctttatttgatctgactcagtggaaaagccctatcctcaggacatttgttgaaaacaagcagcagcaattgtttagcactgtatctgcctgaggtggctgacttttagaccctgtgcaagcaggaagtgaaggctatggcagaattgtaaactctcagagcattgaaggcatacccaacacagggccctttggcaaaggatgaaagatctcttggttcaaaacattttagaaaatatgtcgatcattagctgaccactaggtagctgaacagatacttcaatggacacacatgacagggaatataggctttacagaactagtccaggaaagtcactaaacaaacagtaacaacaaaccttaggggagaagtgatctgatttccaaactttccactttatattgtttaaaatgtctagttttcaaccaaaaaaattaaaatacaaccaacagtaaactatggcacttaattcagggacgtaagcaatcaataagaactgtcactgaggaagcctagatgtgcttactagatgaaactttaaatcagttgttgtaaacctcttcaaagaactgaaggaaatcatggctaaataaaagaaagtatgagaatattagacatattaggaaagaaagaagcatttatctaaacatattggaaactatagctatgtggtggtgtgctagaggataaatgaagccacagggtaaacatgatgtctcttcttcgaatgtcagttttccagaattaaaactgagagcataaatttgatattgaaacaaatataggtatgttatagtgtagaatgtaaaattcacaaaaataaagcattatgaaatttgccatttgtgatgggccacttacggcaactctcaattcctactcatttcacacctttaatttattttgcctatgatgtacgtcagttgaaaagtttgagaagtctaatctaatgatctgttgcttcagtgattgtggaccaatgacaatcctatgttagaaacaaatgggcatgtcacagataagagataactgtaatagaaaaccgatttccacagtatactcactaattgaccattgtgttattttcacacttggaatatcctacctttgatgaacaaaaggaatacctttacacctgaattgacatttctccaaaaaagacatgcagatagctaataggtacaggaaaaggtgctcaacatcactaatcatcagggaaatgcaagtcaaaaccacaataagctatcacctcacacctgttaaggatggctgttatcaaaaagacaagagaacacaggtgttggcaaggatatggacaaaagggaacctttgtacactgttggttggaatgtaaattggcatagccattatggaaaacagtatagaggttcctcagaaaattggaaatagaactactatatgatcaatccagcaatctcacttctgggtatatatccaaaggaagaaaatagtatattgaagagatatctgtgcccccatgttcattgcagcattattcacagtagccaagataacaacctaagtgtccattgacagaaagtggataaagaaatatacacaatggaatattaatcagccataaaagaagggaatcctgccatttgcaaaacatgagtgaacctggaaaacattatgctaagtgaaataagccaaacatagaaagacaaatactgtatgatctcactttttatgtgaagtctaaaaaagttaaactcatagaaacagttgtatggtggttgccaaggtctgaggggtgagggaaattgggagatactgagcaaggatacaaactttcaattataagatgaacaagttcttaggatcttatatagagcatgggtggtgatgggtgtgataatttgattgtgataatacacagtgtgtatacatataacaaattatgttgtacaccttgatctataaaatctttacttttcaattaaatatttttaaaagggaatacctttcttgttttgaaaatgcttgatgtgtcttttctcacattaatgtaatttagaggaagagaaacagatttgaagaagcctgagccaagggattataagttatccttgaaagcacaaatactatttatcatgcagtttccctcatgaaatgttttacggcagacctgtttatctcatagatctgagtcaaagctgaatttaacacgttaaactttaacttatccagaattagtatcttttgtctaagaaccaacactaaaatatttccttatgttaatcaccaacactagaaatttgcttaattttttttcaaaaacaaaattttgtatcactttttgagttactgcatagtttataatgcaaagaaaacatccaagcttagtgaaatgataggataattactaacttagcaattcattcacacatattaactttaaagtacacaagattcaaattcttcaaattaatttctcaattaaatgaaatacaatgaaatgtaaataaaataattaaatgaaaattaattaaggaccttaatggttgcttataaattcctgaaattgcggattgtatgtccatggagtctgaagatccatagtaattaaaacgtattgtgttatatatgtttatagtatgctcatgctgttttttaaaatatgtatagaacattgaactccacataattgatagcatcataaatatcattgagactactgttgttgattttcatgagtgatttcctctatattatctgctctgtttaagttgattttccaagaagaggtcttaatgactttgtaatcactcttacagtgttttattcattgtgattgactatcagtatttttcctcttgcagcctgactcctaaacccagagtctcatatacaattgtaggtgctacgttaagagagacagggcagttatatggaaagtattatgtgttctttcttttcgcttactcttctctctctctcccccaccaaccacacacaaaggtataaggttgttttcatatcatacctgcaactaaactcattcaggatccccagacctctctaaatgggaaaccacttgtaataggtttaacatctcctaatctagtattagggtaatgctactattgttgtaaaagtttctcataacttgtaatttgctttggcatcattataatgaataatcaattgtatgatataaaatagtaagtgttctaatgaaatgcattttaaaaatgtttgattccttataagacttagatcttataatgaccattttcttatttgatcaaagaaatacactgagaccttagtaagcttccttctgtttagttatgacttcaggtattgaactagatgctgtgcagtcagtcctaccatgactaggatcatttatagtctctcatgttcttttatttaaaattaaagtatgtgaatctttaaaaaaataaagcagtattttaaaaatacttgaaatacagccaaacgtttataacaataaatgcttttttattccatctgttattaaaaatacatttgtttccctgtagtcaccaaaggtaaagtagaatataaatcaaagctgatcatattttctctcttctaattctatagatgtttatgaactttacctagcagcttatgtgtacatatcaccagggattccacatattttgttgggcaattttaagagctgatgccttttaggaagacaccaataccagaatgattttcaaactcaagtaaagagggtatttctggaatattggagtaaggacttcagaaaatctactcccctataaaagcaatgtctggcaacaattgttaaaaacaagtttttcagaattctaaaaattaaccaaaagcttccaacaacctgaggagtgtttattcaataaaatagctgattttcggttaaaaaaaaaagttagatttgttgtattttaacttgccctaatccaatcaacctttccccagatccaaaatatctctggaaactagtaaccttgcatccatggtagctgtgaaaacctgtagctactggagagttgcaagctcctcacatcttatccccagataattgtcactattgacctgtgtggtagctccttgggaaggccccattcacgaggcttgtctttatttgatctgactcagtggaaaagccctatcctcgggacatttgttgaaaacaagcagcagcaattgtttaatactgtatctgcctgaggtggctgacttttagaccctgtgcaagcaggaagtgaaggctaaggcagaattgtaaactctcagagcattgaaggcatacccaacacagggctttttggcaaaggatgaaagatctcttggttcaaaacattttagaaaatatgtcggtcattagctgaccactaggtagctgaacagatacttcagtggacacacatgacagggaatataggctttacagaactagtccgggaaagtcactaaacaaacaataacaataaactttaggggagaagagatctgatttccaaactttctactttatattgtttaaaatgtctagttttcaactaaaaaaaattaaaaccaacagtaaactatggcacttaattcagggaggtaagcagtcaataaaaactgtcactgaggaagcctagatgtgcttactagatgaaactttaaatctgttattgtaaacctgttcaaaaaatggaacgaaactgtggctaaagaattaaaggaaagtaagagaatgatgtctcaccaaatagcaaatatcaacagagaaagagagacgttataaagaaccaaatagaaaatctggagttggaaattacaatagatgaaattaaaaaaattattaaaagggttcatcaacggatttgagctgacagaagaatcaagaaacttgaagataggttaactgagattatcatatgtggaaaaaaagaaaaaaggtagcaaagcctaagagacctgtgggacaccatgtagtataccaatgcacacataatggagtccctgaaggggataaaagaacatttgaaggaataactgctgaaaacttcccgaatttgatgaaaatacttagtataacatccaagaagctccatgtactcaaagtaggataaactcaaaaggattcacacccagatacaatgatagtcaaattgttgagagacaaaaagaatcttaaaagcagcaagagtgaagagactcacaagggatcctcaataagcttaacagctaatttctcagcagaaactgggtcggaagggcagtgggatgacatattcaaaatgttagaaaataagactgtcaaccaatatttctatatctagcaaaactatattttataaaggcaagataattaggacattcccagataaacagaaacagataatttgttgctgaagacctgttttggaagaaatatgaaaggtaatccttcagggtgaaatgaaaggaaactattaagttgaatgtacagaaataaagagtactggtaaaggtaactacataggtaaacataaaagacagtataaaggtatgtttgtttataactcttctatctgatttgaaagacagcagctgcataaaaaactaattataaaactgttgatgggcgtatttcatataaagatgtaatttgaatgacagtaatagcacatagggggagggagggaatagagctataggggaacagagtttttgtatattattgacactggttggtattaatctgaactagattgttttaggttaagatgttaattgtaattcttaaggcagccattaagaaagtgactcaaactagaataaagaattggtagttagctttagaaatttcagtgctttggcatgcaggttagattctgaaagtgaggttatagattatttccaaagttaagctttagttgacaatttcatatgttgtaaacatgtacaagtatattgcctaagtagaatatttggtacctttttagataaacttcaataaaatacagagaaaatttataatcattaattctcagaacattttcatgagttaagaattgattattgctccagtttttaatatgagaaaactataccaaagagaatttaaactttgcctgcctcttccaagtatgatttctaatatggtgggagttgcagtactcaagcatggtttagtaacatatccctctactctcctcaaagtgcttaatgatatttttgatattaaaattaatatctttaataatttcatcacacttctcaagaaactgaagacagtttaaaagtctctttgagcttccctgcctttctttcagaacaatttcaagagaccttcagtctaatgtgaagtatctatcactaaatgtgtacatctattgcccagaaagttgtttttagctcaggtggagtctctaaatagaccgtggaaaattgttttctgaaataattatggcacatcaataaaactgctgagtcttttttttttaaaatagaggtttatggattttagaatttagttatctgttaatgagcaaattaaatgcatccttgaaaaaattaattcaagtattttttttttaagtttatacctaaggcagtgtgggagattcaaaggtagaagagatgtggttcctgccctcatcaagacttcctattaggttggtgcaaaagtaattgcgtgttttgccattaaggacaagtgtaaagagttgtaatatgaaaatggattacctttcataattaagtataacgtatctcacctaatgacttacaaaataacaaagttcagtatcataaataccattataacttacattatagtactgatttgttcctctgggaagaaaatcagcttttcttttgacttggtttgagttctgtttatttgagaaagaactaatgtggcaaaccaaatgaataaaagctctcaacaggttttaacgcatcttgaaccatctgctattagcaccaagccagtactgcaatgtttctggagctggctgtcaggatcagggatgtcctgcagacaaaacaagattcctagtgtaggaagctattgaactggtactctcagaagtgactaccatcttcttccctctccccactagggatcttagtctccttatttagcatttgtttaccacatttcaaaagagtagcttagcagttttttagaaatgtttcagcttagatgtaagctgtacatgattgaggaagggagaaaggacacagtgctagtatatagatagtaaaagtgctgatctcatctccgtgaagtcagagcaacatcctcggggatgaggcttggtctagttatgatagcatactttctttccataatatgcttggaaaaatatttaccctcaaaacaaatccactgtactattttaagcaaattagtttggttttaaatcatattttaaaagttatttaatttttaaattacgaaattttaattaaatgaactgtcttcagagatgattgacctagacacaagtaactatgggaatactgtgatagataaggcttccctgcccttaagaagtttatactctagtaagagagctaagttatacaactcagataactgtaatacaaataagtaagtgccttatataggtataaacaaagcctgtagtagttagaggatgatgactgtagatgggagattttagctaaggtgtctgatgagtcattgggttcacagacatacagatattaagattaaaaggaaatttataaatcatatttccatgaaaaatcctgccttcactagaataagcctacatatttttcagcattggtatttagggatagacagctgttgacctgaggatgacttaggctaatgagttaatttttaaaacatcattacaggggcagaatcaatggtaaagtatccttctgtgtctgggtttataagagtaggtcaaaaggaatggccaggataacaggtcagataaattcaagaaaatcaggccccctaatgtgtcagacattgtgacaggtacaggtaatactatggtcctttgctcttcagtagctcatagcctagcaggagaactcagaatgctagatcattggaagaacttatctctaaatcttatcccatgatccctggaccttctaaactagatgaaggaaaatataccagatggtggggatactttaaaatcttctgacaggaaaactgtgctcctggaatgaactttttaaaaaggtagtatactcacatggtgtgaaatccaaacacacgaggacaatgagatatagatttccctcctactcctttcgcccagctacctaggtgctcttcacaaaggcaaaaactgctgccaccaatttcttgtgtatctttacagagacagtctatgcatatactactagaatttatgtacatatgcatgtctttttgttttgcacaaagagtagcatactatacatacttttctacatctttttttgcagttaacaatcaattttgtagatactttttaaaagactgttttaagagcagttttggctcacagtgaaagtgagagaaaggtacagagatataccgtatactccttgctcgcacatatatatagcctcccccattaacaacaccccacacctgagtggtacatttgttataactgatgtccctacattaacacatcattatcacccaaacttcatagtttaaggttcacttttggtattgtacattctaagggtttggacaaatgtataattatatgtacccaccagtatagtatcatagaattttcactgtcctaaaaatcctctgtgctctacctattcatttctccctccctaacacttacctttttactgtctccacaattttgcctttttcagagtgtcacatcgttggaatcatacagtgtgtagactttttagattgacttcttttacttggcaatatgcatttaagtttcttctccatcttttcatggcttgatatttcatttctttttagtgctgagtaatattccattgtctagatgtactatagtttgtttattcattcacctactgaaggatatgttggttgtttccaggttttagcaatcacaagtaaagttgttataaacaccatttttctgtgggttttgtgtggacataaggtttcagctcctttgggtaaatacgaaggagcatgattgctggagtgtatggtaaaagtatgtttagttttgtaagaaactctcaaactgtcttccaaagtggttgtaccattttgcattcccaccagcaataaacaagagctgctattgctgcacatccttggagatacttctgtatcagcacacctgcaacttcctggttcttttctttttaaaaactatttattttgaaataattacaggctcacaagaagttacaaaaatagtgcagcaaaatcctgtgtacccatcactcagcttcccactggtgatatataattatagtgtattatcaatactaaaaaattgattgtcacaatgtaatcaactagacagcagtacctgtttctttttaatgcctacaagacattccattctatgggtgttttatttaaccagtcctttattgctgggcattaaaattgtagtattgctggtatagggaaagataggagaaaataaagtctgtgtattcggggccactgctggcatttacattgcttttatgtgaattagaaaagagttccctctctgggtggatgtagtcccataggcacatggcttgggaaactagaatataacctagataaatgtttttagcacctctgcatatatatctctttgaacttaagtgggaatacatatgcaggataatggactgtcatttaaattctgcaatataacatcagtgttccaatgtgaaacttcgaagctgtccctttcagatttagcatgtgctcccatcctcctacctgtaaccgtcatcacctctcccaagtaccttaggtcttgtatattttgtgttattattattattaagacagagtctcactctgtcgcccaggctggagtgcaatggcacgatctctgctcactgcgacctctgccttccagtttcaagtgattctcctgcctcagcctcctgagtagctaggactacaggtgcgcaccaccacgccggctaattttttaaaatacttttactagagatggggtttcaccatgttggccaggctggtcttgaactcctgaccccaagtgatctgcccacctcagcctccccatgtgttgggattaccagcatgagccaccacgcccggcttgtattttctattatttatgtacatgtctaccttacattggatagtaagcttctgtcttcttctttatattttctgtcttcatctttatattttctttcccttctcttccccactccactattatcaatctacatagaacatcattttttataaacgtgctgagtgaatttttgtttaaaatttttcttaaggtgaggaagttaagagcagtgaatttttaaatctgcctctcaatacttcaagaggtgtcatgaaatttttaaaccaaaattattttcaattaaagtacccacacactccacactcataggagagaaaaagagtgtgttattaagtcaaccaactcataatggggtgctacagtttcaaaaacattaataagcattgtagtattgaagaaaacggggtagtagaacttgtgacattgcaagcagggaagtattttatatgtattgtacactcatgttcaataagtagaattctgagaagttgcataagtcttgtgccctaaaaattcctgatttcatcagatcttaacttctgtatgccattgatttaggagggaaattgtccatttttaacactggccttttcattactgttaagcaccagaaatattttataaaattttaataatattaaatatttcattaaaacttacatcattggactcatatgtggtacatatcaggactgctacaaacacacaagaatggaaatgtactttttaaaaaaaatgtgttttctattacatagacgttatactagcaatgtaactaaaattagcagagtaatcatacagcctaatcagcacataaatcttatacaagtgacaagttaaaatagataatagtagttgcaaaagtagcttgagatcaatatcgggtggttatgtttgcttgtatatactatttaaggaggtaagcattggggaagttgggctgaataaaacgggggaggcaagggtgagaaatgctctttagatctaatgttcacagtggatcatcaagtgagaattgctttgctagcaacacataaatattttttcattataggggatgactgttactgggaaagcattggagtaaatatttgttttccttgattatttgctgtaaataattttttgtaaccaaatcaacaaagtactgtgagttcactataggatattacattgtaatatagaagttcctgttttcctgatgttaactataatgggtttctacctgtattccaggaaatagagcaagttgggttgattccagtatgttttatttttcagcttcagtgctaaaatcagattgtgtgcaactctgaatcatggttctataaattcttggctatactaagtaaattacagtatatcttccagtacaattataagaatgctgtaacatgcaggatgttttcttgagcgttttcatgattaaagattaatttcttcctgaatttggcttgatagatttgtattgaagagcactgtcaactaccatttgagtgccatctgtgtatttgacagtatactgtggactaataggaatttaacgaataaaatagtgcatttttggtttggcaggatttcttacagagataaataggctgggcacatttgccttgtaggtatgtgtgtttatgtacatatatgtttcatatcaacgttggcctgtaaacttccagtataaatagaataatttaccaacttgttcttccactgggacataatgtaagtaaactatcttttctagctaactaagcaggtggctatttctatgactagtatgtttcaaattttaatatacattgatgtaattaaattttgtgtgtgtctatgagtataatcatctctcattatctctgcttctgtgggggatcctaatgtaaatagtgtaaaatagtaatatccttgcctccttttcttgactttttccctcattctgtgaactggctttatgtgccttctgtaccttgctccagtgccttaagtggtcagaagtgggtgactaaaagaggtagaaattgccacatgtggataatggggagttgggtatttatgataatacatgggaatgagggagacatattaataattttgaagttaatggacttatttgttgagggaaggattcatggacagttttgaattatgtttcaaatatggatttagaattttatttagggggagaggactagacattctagtcagtgaggatcataaacagagctgagtaagtagttttgtttagagagctgttgggaaataagtatatttgagaattcttgaatcaagagagagaagagtggagtggcttaaaattaaagcatctgtttattcattttgacttgattttctaacctatgtgggaatgctgtagaagttatatggttgaataagtgagggattagacacatttaaatcagagtcattattgaagaaaatatcagaatagtttagtccagggtggactctagtctacataagaattagctgtgagattagatttgtgaggaaagaataagtacaaacaatagtacaggaaagaaatggtatagtttggcatttaactgaataatgtgggtggtgatctagaggctcatgttaggctagcattgtttatccaaaaagaagggctgtaccatttctaatgaatttggagagctctgtcagccatacattgatgaagccctgcagtaatgtctatgattttgcttgcagttatactttgaagatctccagtattctgtcagtttctgagagcgcacaatctgactcttgaaattctggtagagcttgtgaggagaaatcaagagaaattgctgagaacctattatgtggtgtgcatccttctggatgttttacatacctgctttgcttccctgtttctctaccaaatcaaatcttctgtaaagatatatgagggtgggtaggtgaatgggcatcgtgctgagggagaactctccactcttcaaagtttttgccacctaaaaaatgccaaaagccatggtgctacttcagctctttgtgagatttctagcctgccttcttcctttactctttttgatttatgctatctgatggctccaagtcacagatactgagctaaagtcctttctgcagtcatggtcctctttcttgcttccctgaactaccaaactggctaagtgtctctcctttgtgtcccataattcctcattcatagctattttcttatcatttactgctgtatattaaattctattcatgtatttctctccttcacttattagagtataagctcctgaagagtgaggatggtctttttcctttcttatcccaagtgcatggcaaaaatagtagagaaggtgcttaataatggtttcttgtactaagttgaccccatcaactgcagtttggcttctcatcttgtttatccttgtgggatggccttgtacactgtctaaaccattctctctattgcgaaagaatggggcaaggaaacttcttagctttctttttagtctcttttattccagccactctatgctttgaatacctagttttgacttgcttcccggtaacagactaagtctttcaggggtatggtattcacaactctaccctgtactagacagtgtcatgtagactagtaacttggaagattaaggtataagaaattgttgaggtcgggtattctgagcatcagtatacacactgatttcttccccagaatggtgatactcaggaaaccagggagcccctggttacataaggaagtgtgaactgctgcagatagaaattggaacaagacatcctcattactgtaactctgaggtctaatagatgtcctccctacaactacaacaaggtggtctgtgttttccaggattggagaagaaaccaaaacaatttgacagtttttgtcaactaggtctggaggcacttccctgaagtaaaaagatcatctgattcaacgactcctcctcagtctcagtcacattaggtgactacaccagttagtgtgtctctgcattttggttctatttgagaaaaatgtttctgtatggaaaggtaacacaatagtaagagatagtttatccttcatcccctcttttgacaccctactcttgaattctgatagctggagttctttttcttaaacccactaccttcacaagaaggcaaactgtttaaactcacctatctctcacatgatagtagctggtctcataattgacagaatcattggcagtaagaccattatctcttttaaccagtggttgaaaattctacttagttgtctattggagctcaagaaactattaacttatgaacgtaatttagtattgaagcaccttgtgggcctcctggctatcaaagataatcagataccccaaaaggacccttgaactggtatcaaaattcagtagtaactaatgtaggatactagggattagcctcatgattttttttaactaaggtctccagatggccaatgaatttatgaaaccggaaggagctggtggaatgggaggacagagaagatgacgttaagtaactttgcatacatgctctaatttttttttttttttttgagacagggtctcactctgccacccaggctggagggcagtggcacaatcacagctcactgcagcctcaacctcccaggctcaggtgatcctcccacctgagcctcccaagtacctaggactacaggcgcacaacaccatgcctggctaatttttgtaaattttttgtagagacgggtttttgctatgttgctcagggtggtctcaaactcatgggctcaagtgatccggctgcctgggcctcccaaagtgttaggattacaggagtgagccattacgcccggcccatgctctaattttttaatggtcatgtgcccattgagcattcatcattcaggtgagtcataactagagactgtataagggtattgtgaaactctatgcagttctttagtcatgctggggttgggttcttttaaaaacagaccatttccagatagtaaccatatattctggatttccaggacagccctgatttcattttgtcccattgtgtccataagtatacttatgttcgttagacgttatgccagtttttggcttggaaaatatggacatcaggcatataaggacttccttcttgccaactgaaaacagttcatcacagcatagccttgctctttcaaccctgccatcctaactgccagcagtctctgattttgctcccatcttgtatctcccacacttactttaaccctttgtgagttaatttatctcttttctttggtgtctccttgcctctggagtccagcaaattgtgtatccttatactctcacaaagctacttgtatcctagcattttggtaataggatgtactcttttgaaaaatgggacactttcttttttcccagggtgctcttgggggttgaaaactgttctgtgagatactcatcttcagaggcctccgaaaacacattcagtaagaagcagtactactactactaccatgtattgagtgtttactatgtatgagaagttgggtaaaatatttttaaaatctcatttaatcctaaccacctgtgagattggtagtgttcccttttcacagataaggaaatatacttagagagtttgagtttttcaagattctgcatttggaaatccttgctacattccaataagatattagttgtgtacataccaggcttagaattgtggatgaactaccaatgactccaaccccattatagaagaaatttcacctttttacttggtaccaccaggaaataagtatttctatactcttggtagatgaatttttatacattcttcttgtataccactggtcctcaaacttgagaatgcatgaaaaccacctgaagggcttgttactcccagtttctgattcagtaagtgtgagaattaagtgtgtaaaattaaacttgagacttaatttctagtaagttcccagtgatgccaacgttgctggtccagggaccacactttgagtcattgttacatactaattattttttattcagcaaatcattattcagtacttatggtgttctaggcaccgttctaagcactgtggatataataatgaaaaggttaggcagggtctttgttttcataaagcttatagtctagtgggacagatgactaattttattgggataagtgaacagggattgccatagagaacaacagagttgctatcctctactttagatgggttgagaaccctgtctaaaggatggtagttgggtctctttgaggaggtgatagtctaagacctaaaggatatgaagagctcatatggctttcacgcttgaattttcttagctccaacttctgttgccatcactggtgatgactaccttgggagaactccatgaatttcagactgacccctgtgtaattcattctttggtactttgtgtggccttggccaagcttgactgaatagttcctttaagattgtttaccccctctccaccccaaccttcccccaccatccagtatagatacagaagtcagaggaattttaagagtgggctaattttgtcttctggcttcacctagatcacattctttggtatatgatggcttgagaagaatatatgctaaggaattgtgcctgtgaacctgccattcatggccactgcccttaccttataactatcaatgataccttaagattctgtcttaattgccagtttgcaaatttgcctcaaaaggggagacagtgtgggaatctccacaactccttagctaccctgatgttaggtttctctagggaagatttctagattcatgcagtctaagaaggtgttgtcagagcaacacaaaaccaaacttcccttccagttgtggtgactaaagctggaaaaattctagatattcgaaggagactttctacggaactatcatgatttcttgccttcagagttttagttctgaagtttgatgccttactctttttttcccccctctggttctgtcctaccatgacttaaccagcttttcctttgaatccctcctgcctctggagccatttccttgctgtctagtttcattttattttttatttttatttttatttttgagacagagtctcactctgtcacccaggctggagtgcagtggcaagatctcagctcaccgcaaccgccgcctcctgggttcatgcgattgattctcctgcctcagcctcctgagtagctgggattacaggcctgtgccaccacgcccagctaatttttgtatttttagtagagatggggtttcaccatgttggtcaggctggtctcaaactcctgacttcaagtgatccaccctcctcggcctcccaaagtattgggattacaggtgtgagccactgcacccagcctcattttattttaattaaatattttctctggtattctgttcctttggaggaaaagagacccttaccaggtgctacggtatgaatatttgtgacctcccaccagatttatatgttgaattctaatctccaagatgatgctattaggaggtggggttatttgggaggtgattagatcacaaaggtggggccctcatgaatgggattggtgcccttttataaaagaggcccaagggagctcattcatccttcccactgtgtgagacacagcaagatgttgttgtttatgaggaatgggcccgcatcagacactgagtctgctggctccttaatcttggacttcctggcctccagaactatgagaaataaatttgttatttgtgagctacccattttatggtattgtaaatagtccaaacagactaagacaacagatatttctctaggtattttcaggcagagcatttcacttggcctaggtgtatgtatttttggatagcagacttccttagtcttctctcaataaattcctgaaccagagaaggggaatatgagtaattgacttttctggttgccaaagatgtctttagtttacatgaaaaatgttttgaacagttatccagtgcatgcttaaatgggctgtctcttataacacatctgcacatacaggccagatttaactaccttacccagattgaaaatttccttttccttgtggactcagaagtttcttcctgctagtctggttcctgatggtatacagtggataaacattttttttttgttaacccatatatcaaccataagaatgactgaaataaaaaaggaaatggtgtgccagctcactcatagctggagatgataaaccttttctgttgctttagagccagatatccttggttggtagtgtcatgtctgctccatattaacagtgtcttgggcaagtaaaccaatcttgccgagaagaagaaaatgcatatgaaagcacctaatagtacttaattcataatatcataatatgctctcactgaatgttaatgcttgctttcctccttgatgttcttaaagccctgaaacacttgattgagcaaggcataatctctcatggtgtaccccatcagcaccataatcttacattttccagatatggaatccgtttaagaactacctgcttaattatatttattataaaaatgataatctcagagtatccctacttcttcaaggtatccaagaaaggaaattaacaattttgggcgtctacctagtagaggtctcattgacccaaaatgatgatagcattaataattatacctttattgacagaattataatacttagcagtttccaggaactttttaatggatagcgtccttggattcctgtagcagttcatcaagtaggcagtccccatcttgcatatctgtgtccaaggatgaagggaataggatgattccttcatggtcttttgactgatggatagtggagctgagctttgggcctaagtcttctgacacccctcctttccctgccctattccagcacttttatccaactatgccacatttttttttttaatctgaggttctggtacatgatttctcaaattactagaattctaagacaaaatgtttcttaggtttcacctcattttatctctgagatgtttatgttcctaagagatagttcttacgtgtgggagttttaaactctacctagaggtcagagaaagctgtttatgcctttgatgtaaattttgtgcaccatacttagactatactacacattccaaaacagtatttcttgggcctagacttgtaacaaaactctctagtgtgatgtattctcattcactcttttatattaacctattttattctttcagcaaacatatttagcccttactatgtgtcaggggataggaataggaccgtgcaaaaagacaacctctgttttcttggagcttacgctgtagtggataggaaataagcaaatgggtagtgatgtgtactgtgaagaaaaataaagcacttttaaattttcgcccaagccatgagattactaaattgtggtatctatcagtgaccccttgtagaccttatagaccttctaaaaagttagttattgagaagatggcccaggaaaggaacattgtctctgacatccctgtgcagtttctaccttcttttccattatttgaactaagatcttgctttcttgtatggttgtgagcaaccctgatcgagtggagtgtaagggcatggccaaacaaagacagattggagaggaagcctgttaggaataaagcaccttcggagaaacagtctcacaacaaatactgttagagttgtatttgtcatttatcctttaaatgtaatgtgttgccttatagagtgtcacatcaagaacactgaaaagagatgtatttcaaaatatgtatttagctatacaatggttaacaaaacacagcataaaaagcagcctccttaaatgcttctagttttatggtgtactactgtagaatgagttctttttgactgaagtgttttaaaagttttgaagaaccagggagtctgcaagttggaaagaagccattcttaccatgaggcaaatatacttgagtttaatttttaaactataactgctgtttgaccttaaattaagacagtctgttttcattgtggtgttttactggtttaacaatgagaacatttaaagcagctgccaccaattaaaatgattcataagtgctggttgtaaataaatattcttgaaattttaactcagtgaagtcagtctttttagtggcactttctttctggaaagcaatttggtaaaatgcatcaagagctataaaaatgttcatacactttgatctggtaattcagtttcttaaatatccttagaaaataaaactgagatcttgataaactttaataaataaagatgtccctcacagtttatcaaggaaatagttgcctaaattatggtctacctatatgatgtaccatggggccattaaaatatttttgaagagtattaaccatataggaaaatgtttatgcaattcagttgaaaaacaaaactatacaaaaccatacagtatgatcctaaaaatgtgaaaatatttccatagaaagagtgtcaggaaacattatacattttcattttctttgggtagtgagattgtgtatgatatttattttctcctttctacttttctgtattttctagaattttttatagtgaacatgtattgaatttatagtgaataaaaatgttatataagtattttaatcctttcaataagggtgccttttatgaatatccagtccatttatattattatgacctaattttttccacattttcagctttagagcatttttttctagtgaatttttgtttttaacgttttaatgtttatttttatggcacataatgtcaacaattttacctctgcttggtctaatttctaggtattcttctttaaagccaataattcagttccttgttggaatattatttttcaggtggtttacatcaaacagcacacacattcgtagtatgtggtaaagagagttgactctggagccacaatgcctgggtccaaatcttggccctaccacttagcagctatgtgaccactgacaagttaatggctctctctaattctcagtttccctttctttaaaataggggataataatagtatctacctcatagggttgttataaggatttcaaagagttattacatataagtacttaattttaaaaggcctggtatatagtaaatattcaataaaaattggctatttttagtagtgtgtgtgcatatatgcacacatatacacatacatattttcatgataatttgaaaaatgcccttttatatctgccttttcttttatacaattttaattttaaaatgaagggttttatcttattttcagataaaattagtttttcttatatgctttgaaattatttcaaaaagttttcagcaatagaaacctggtttgctttcaatcatattttttccatatttgtaactgatcattcacgtgggctggatggactgaagatcagcttcattctaggtataaaataacttttatttacatacacaaagttgatatattcataaccagttaccctcatctattatttacctcatttattaaagtactgctttaatagagaaggagggggatgggtaggtgtcagtatacttcaaaaataataaaactacatttgtttctttttaaactttataatccagccttctctaatcaaactgatactcccagaaagatttggagggaaagagagctaccttttattgaatcacgtgttgggctagactcttacatgtattatataattctgtagtccaatatgaaaactattttaagtaaagcaatcatttggcaattttactgtcctggattacagaatcacaaatgtgttcctatagaaaacaatttggatttaactgattaactgtttattaaataactaattgcaatagtttttccattattctgtttcatttttttgaaacaggtgtttctgtggtatgtttgcattggcagaataaagaaagaatctgggcaagtttgaaagcatgaaactggtcactgaaagtttcttttcaagaatgaagcatttttttaatcaatctaataatattcaacagagacacatatagataatccagatatcttcatctttagctggatatttggttagtatttaatgccaagaaggagtgtgagaagtagtccctgtgggaaattgtgttttctttggtctttggttctacagctatgtagaaattctggattgagtatgaagtttatttatacatgtacatgtacatttatctgtgggatttatctaagaagcagtggtttggggtattgttcttgctggtgaaagaagtggactgggtggaactctagagaaaaatttgcttttagggataaacatgttcaatagctcaggtggcaaattttgctttcttgtattgatgtgataagctgagtgggtcactgccatttccagaccatatacaccacctttggctgatttgtcttctgtcatgtacctagcagttcagctggaggctttttaaaccaaagtatttaaatatacataggaagttgttgtactggtgcttattggtggctactgtgttctttcttatcttcctagggagtgtggtccttttgtttagcttctgtttcatttgtttacaaagttataggctttgaagtaggcagttatatataggattgcctaaagagacgtggaaagtgagaagtctgctttataagtaagcaattatccttatttcactgccttattacctcagtttctcagccagtgtctttcatgaatttggcttttctcataggcttgacattggcttacttactgctatcctaatttttttgtggaaacttacttagttttgtgtctcccagattagatactagctcagtttactttctgaacatttaactatcaaagctttgcctgatgtgttagtgaggaatttttaaaaaataatttttgataatttaatgatacacatcacattattttttctatttgttccatcataaaagaaattttcatatctggtttccttaatgtagggttcctggccttaggtgactgtccttctatagatatggcattgttattacaagatttgtactggtaagactatgataaatttagtgttttctaggacagtagtgaggtaaatagctgtgctgtaagattgtttaaatcatcatagctgaaaaaataggcctttaaaaatagcgataacagaatacacatacattagacataatgcatgactattaatgacttcctcaagatcttttaggagttatgaataaggtcattcagattgcactttttttaaactcatggagagagtataagaggagtgagctatttttggcatgggcttaaagaaggaaatatcagtgtgactggtaactgacatgtttgtcaagttcagtttctacctgagtgctttaatttcttttaaatttcattactttggactttagagttctcagtatgaaattttttaagagtgacttgtctaacctttgggttctgagtagtgtgttgcccctgaaattggttgagtcattttatattcttctaagagttcaccacctgtcaaagctgaagagatctgtcccttttgccctttatttcctgaaccatttttctttttttattattattatactttaagttctagggtacatgtgcacaacgtgcaggtttgttacatatgtatacatgtgccatgttggtgtgctgcacccattaacttgtcatttacattaggtatatctcctaatgctatccctcccccagccccccaccccatgacaggccccatgacatgtgtgatgttccccaccctgtgtccaagtattctcattgttcagtgcccacctgtgagtgagaacatgcggtgtttggttttctgtccttgcgatagttgctcagaatgatgttcctgaaccatttttctgctggcactaatcttatttgtgataggttttcccacatttaatatgtaaaacctaccacagagtttgaaccttaatgtgacttagggttaaagggctttgagacttctacttttgtccatgaaggagtaactggtgcaagacttgctcctttccaccttacatctcccataaacaactagaaaccagacaaaatacatgaaacaactgtttttagacatcgggcaacagacagcacaggactgtggtcactgagagaaagggaacaaacgaagtgagctctaccatcaccctgactttttgtcagcaggcagtttctagaccacagcattgtgagggggaacccaagcagaactgcaatcttgctgaattggtgagacagagataggaactcagggaggcctaggtggcagaaatttatggagcagagtactggaggaggaaagctactcagagacatagctccagaaatctgcatagatgttccccttatctctggctgaatatgaatctgtgcatgtatcaagggcaacactgtgaggctgggcagaaaacaactgctcaggagctataagctgaaaacttaccagagctcatacagacctgagagatatatgagttcctacagcaagagttgtgagcccttgttgaacacccagggcattccagagagactccagaagggtcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaagcagattaacctacttgcaactggagtcccataaggaaaggagagagagaaataggcagaaaaaaaattgaagaaataatggctagaaattttccaaatatgatgaaaatgtaaatccataaatctaagaagctcaatgtatccaaaacagaaaaaccacactaaagcaattataattttttaattatttatttatttatttatttttgagacggagtttcactcttgttgcccaggctggaatgcaatggcaccatgtcagctcaccacaacctccgcaccctgggttcaagcgattctcctgcctcagcctcctgagtagctgagattacaggcatgcgtcaccacacccagctaattttatatttttagtagagatggggtttctccatgttggtcaggctggtctcgaactcccggcctcaggtgattcatccacctcagcctcccaaagtgctaggattacaggcgtgagccaccatgcctggcctaaagcaattataattaaattgttgaaaactagtggtagagcattttgaaagccactaggaaaaaaaggacacattacagaggaacaaagagaagaaccatatacttctcatcagaaacaatggaagcttccagaagacaatggaatgacgtctttaaagtgctgaaaaaaaaatactgccaatctcaaatttgataccaatgaaaacaccctttaaaaatgaagaccaaaagaaatgaaggtgaaatatatatttttttcagacaaaaatgaaaagaattatcactggcaaaccttaactacaagaaatttaaaggcagctgtccaggctgaaggaagatgataacagatggaaacttggatctctacaaagtaatgaagagtgccagataaatgtggcaagtgtagggtaaatataaaagacattttccccctcattaaaaaatttctttaaaagttaagttattatttaaaggaaaattaataatctattataggattatatggtatatagaagttaaaggtataacagtagcctcaaaggatgggaggagttaaatggacgtatacgttaaggtctttacattgcttttgtagtgatataatattagctgaaagtaggttgcaataagataaagatgcatcgatacaacctagaaaaattactaaaaagggcataactaataagctaataatggtgataaaattaaatactaaagtatactcatttaatcttacagtaaaagagaagtggagaacaaatgggaaatatagaaaacaaatattggatgtaaagatggtagacttaaacccaactctgtcagcagttatattaaatgtaaatagtctaaccactccagttaaaaggctgcataaaaaatgcaagacctaaccatatactgtgtataagaaacccactttaaggataaagacacaggtatgttaaaagcaaaaagacagaaaaagatatacaaacattcataagaatgctagagttattatgccaataagagatgaattggacttcaggacaggcagtgttacgaggaatgagggccatgtcataatgataaagtggttaactcaagaagacaaaatactaaatgtgtatgtacctaacagatcctcaaaatacatgaaagaaaaaaaatacacataaaaggataagtagacaaaactacaattagagttggatatttcaacattattaattcagtaattgatagaacaagtagacaaaaatcagtgaggagatagaaaacatgatcaatactaccaaccaactggacctaactgacacttataaaacattggacctaacattaccagaatacattttcttttcaaattcacaaaagatctctataaggagacctacaaaacactgatgaaaaatcatagatgacattaacaaatggaaaaacatcccatgctaatggactagaagaatcaatattgttaaaatgaccatgctgcccaaagcaatctacagattccacacaatcactatcaaactaccaatgtcatttttcatggaattagaaaaaacaatcctaaatttcacatggaacaaaaaaagaccatgaatagccaaagcaatcctaaagcaaaaagaccaagttgagagtcatcacaccgcctgacttcaaattacactataaggctatagtaactgaaactaaaacagcatgatactggtacaaaaatagacaaacagatcagtggaacacaatagtgaactggatataaaaccacatacctacaaccaactgatcttcaacaaagtagagaagagtaaacactggggaaaggagtccctattcaataaatggtgctaggaaaattggctagctatgtgcagaagaatgaaactggacccctatctcccaccatatacaaaacttaagatggattaaagacttacatgtaagacctgaaactataataatcctagaggaaaacttaggaaaaactcttctggacatttttctaggtaaagaatttatgatgaaaactctaaaagcaaatgcaacaaaaacagacaaatgaaacttaaaagcttctgcacagcaaaagaaataatcaacagagtaaacagagaacctacagaacaggagaaaacatttgcaaattatgcttctgacaaaggactaacatccagtatctacaaggaagtcaaacaacaagaggggaaaaaccccattaaaagctgggcaaaggacatgaacagaaatttctcaaaagaagacatacaagcagccagcaagcacgtgaaaaaacattcaacatcgcgaatcttcatgcaaattaaaaccacactggggtaccatctcacaccagtcagaatggctactattaaaaagtcaaaaaacaacagatgttggtgtggatgtggagaaaagggaacgcttatacattgttggagggtatgtaaattagttcaacttttatggaaaacaggatggccatttctctaagaactaaaaatagaactactgtttgacccaccaatcccactactgggtatctaccaaaaggaaaagaaatcattacattaaaaagacacctgtactcatgtgttcatcgcagcactattcacaatagcaaagtcatggaaccaatgtaagtgtccatcaacaattgactaaataaagaatatgtggtgtgtcatgcaccatgaaatacaatgcagccattaaaaaaagaatggaattgtgtcctttgcaacaacatggatagagctggaggtcattgtcctaagtaaattaagaaacagccaaataccatatattctcacttgtaaatgggagctaaacagtgagtacacatggacataaagatggaaagaataatagacactggagactccaaaagtgggaagggtgagaggggagtgagagttgaaaaattacctatccagttcaatgttcactatttggttaatgggtacactagaaaccaagtccccaccagtacacagtatacccatgtaacaacaagcacatgtaaaccctaaacctaaaagaaaataaagacaaataaaaaacgcttaactgttttcattgttttgtttgaagtgttacgaattccctgaccatcctgcatacacagtcaaatggaaataccaaaacaaagttccatacaagtttttaatggcataaaaaataggagttgactgtatcaattaatattcattctaaaatttctggacctagttcttctgttattcttagttttgcttaacatttagcttaggaatcggaagacttcaatagaagctcttttttgcctgatttgttttatattaaaataattaattattattatttttttgagatggagtcttgctctgctgcccaggctggagtgcagtggcccgatcttggctcactgcaagctctgccttctgggttcacgccattctcctgcctcagcctcccgagtagctgggactacaggcgcccaccactacgccctgctaatttttttgtatttttagtagagacggggtttcaccatgttagccaggatggtctcgatctcctgacctcgtgatcagcccgctttggcctcccaaagtacaagcgtgagccactgcgcccagcctaaaataactaattttttttaatagtaaagactaagtctcaaaccttaaagccctttgaacaaatgggttcagaataggacttccaaatagaaattacttcatttttgaaatctatagcaaaatgtcatttaaaattaagttgtattttcaggtaatagagatttctggtgtgttcctattatcaggaaaaaaaacccacagctatttttccctttaaatgttctcagtgtaaactaagaaaatatgtgcaaaaatactatttttttccaattaaggtagtctttctcatctaatttagggctctaaaaaactataagattgtctcagcatatcaaatctgggactaattttttttttcgtttgctgaaaattgttgatttgctcttgttaaaggaagaaatggttctttcagttcaaaaattggcagaatcaagctaatcccttaaagtatgcttgtgctttggctgattgtatgtctgtggtgattacccttgattaacaacagcaaaaaattctaccttcccaatcatctgttagactttagtctgccttccttcctctggcatttgccagttaaattggaattatataaatgggagaaagggaatataatgctgctatgatagaatttcttggaacaccaggcaaagaaaagtattgaaagattggtcctgatccccgctttcagatatttgtggtctcctatactaatttatgctgtctatctaagcagtatgatcttattttcctgagccctgtggggtacaggctatttattatacaaagcttggagggaggagtgtggtataaggatacagtggtgacttagtgcattttctttatctacagcaaatggttggatgagaaatgcatctgaatcttaacttctcgaccctgcctcagattagccccctcccatttctctccattcctctcaatttgaatttcatattatctggaggagtctcattcattctataatatgaactacttaatcaaataatcagatcaatacctagctgaggagttgttaaccaatggtataataaatggaaattttgatttggaggaaatttgtatttaacagaggacctgggtttgatgaagtccagctagacaacaggaaaaaatgaagtgagaaggctgagggagatcagaaagagtgctgggaagccatcaagcataaaatggtaggccttgctgtgggcttctaatggtgataatgtagaaacttataaattggggctagtgtttctaggctgatgcagcatttctagtttgtcctggtgtcttctcagctaatctttctctctcccctactgggagaaacaggaggaagaggagattgtgcttatgctcacctgtgtggtgctatgtagtattcataggattttcctattctttggtcttttagaagacacctaggtttgccactcacatttttttttcctgtagtgggggaaaaaaaaaccatattataccagtagtaagaaaatttggaggacttgccaggttctaacactaaccagtttggtgattctgcactgtctgcctggatctctttttgtttttcacctgtaaaatgaaaagcaaatggattatctcttaaagactctttcagtgaatgagcttagatacattgttatatacactttaaactatgtactaaagtttgggttagggatttgtaatggactgaattgtaaccccccaacctctacattcctatgtccaagccctaacccctaatgtgactgtgtttgataaggcctacaagaaattaattaaggtttaatgaagtcatgaagatgggggcctgatccaataggattattgtccttataaaagactgttggagagctcgtgctctccctctccctgcacacactcagaggaaaagctatgtgagtacaaagtggccgtatagcagccttaaagcctagtaaaggaagagagcctttaccaggaactgaactctgccagtaccttaatcttgggctttctagcctccataacagtgaggaaataaatttctgttgtttatgccacctagtgtatagtattttattatggcatccctattacatgatttaaccatgttaggtatgtttttatgaattgaatctgtagtttatatgatttagaaatgaaatgtaaagcttctttttgttgaaataggaagtgaaaggtttttacctggtggtggaaagaagacatcatcatttctgtacttctgcaagctgctagatcctggggaattatggtatttttagctggatgttatgaggaatatagttgtatttttgagctaaattgctgagaaacctgaatacagttgagaaacaatcattatttgatggcagaagaacagaacaagttacagggcttctctcttttcctgtatccccccccccaatataaataaccttgttgagtaccctattctattaattattataattattattgcattggtagagattgatgtaattttgttaatgttgcctcctataaatctcattctaaagaatcttattctaaagaagagcaaattgccagagtctaagacttttttgtaacctctgttttgccttgatatggcaggagagatagggtttaaggtaaaatattattaagtaaatacaccttttttgttgtatcacttaattgtattctgctcctgcaaacatatttctgatttgttctggctcacatcagtagatggggagtgccctgttcagatttacattgcttttcgtacttttgctgattgtatgcaactacatttccctagagctactgttgacctgacagtattggctgctagttggcagggaggattcatcatctagattagatggttacttcctgttcctgtctacagacatgaaaaaatggagtgtttacttttctccaaaggtttctcagaagtaggaaaattactttaaaagctttgtctggttgccttcagataaacattttcattaatatttcatctcattttgagccctcttctagtttgtagtattttttcaatgtatgtaggtggcctcaaaccatatggcaaaagcatttcccaaaacatccaatctttgtcttactatgaactggttttctgtattttttttctcattgagcagctcctctcaacaggctcaaaaccctttttctactttgatctgcctctgattatgctgatgtattaggtcctttttggaactcatacatgttttaatagcacatttaaaaatgaaattgcctattccttccctctgtgttgcgtgaagaaaaaaatttgttcctatttttagataatatgtgttgaatgttctcgtagtcattgccctgtacaacgtggttatcacacacaagatacaatgtcttgtgctcagggatgtttattacgtttctgtctactttaaaatgcttaacttcccggattcttatccccattaaatgttgcttttaggtattttagttgtttttaattccatacacgtgtactttataaaatatgttggatgagcatttgtaatgagaaattagagtcccagatttttaatgaatagttttgttctgtctactaaaagtctgacttcttccatcttcaggcatctgtcctaaacacagtgaggttgtggagtagcactccctcccatctttgacacagatacttccccgcaatcccaactcccaaagtggatgttgcctggggtaggtaaggatcagggagagtatagatcattctgtatctgctctacgtcttatgaaggctcttgagaacacatagtccacagtgcttcaaattcaaagaaatgttaaatctgaaagagcccatagcaagttatcaagactatcagactacttcctgtttcctgaatgtgctgtgcacttttacatgtccatgcccttgcttgttttggagcatctttgctcctcaggctgccttgtaaaatgcagcttgtcctccagcaacttaagctctgaattaatcattctgtcatcagtgatagcatggcattataagaaactattaatatataatttctcccatcttatgtttgagtgccctacaacgtatttcatagtatagtgtttagtttgtgttatttttctactttaagttttaaatgtttacttgagcagatagggttatattatagtaagaatggtgtatgtatatatttcctgggataaataagaaagtagaaggtaaaacacttaaatgactttcatttctagcgtttttgataggaaatgaattcactcacacttttaggtttctcatggaagtcattgaggaagagaatatacaacgtagttctgccttattcagaaaccatcatggtattttaaaaacatgctattatctatattacattgtgattcacttcattctgaagctgccaaaagacctgtcttacatagagatactttggatagccattgttacgggagaggattgatacatttctgtatttctgatttcttaatttatgatcatatgctacttctgtgatcaaaaaataaagtttttttttttttaaaaaaaaagaagagacaggatggcgatcattaaaaagtcaggaaacaacagctcctggagaggatgtggagaaataggaacgcttttacattgttgggagtgtaaattagttcaaccattgtggaagacagtgtggcgattccttaaggatctagaactagaaataccatttgacccagcaatcccattactgggtatatgccgaaaagattataaatcattctactataaagagacatgcacacatatgtttattgcagcactattcacaatagcaaagacttcagaccaacccaaatgtccatcaatgatagactggataaagaaaatatggcacatatacaccatggaatactatgcagccataaaaaggatgagttcatgtcctttgcagggacatggatgaagctggaaaccatcattcttagcaaactaacacaagaacagaaaatcaaacaccacatgttctcactcataaatgggagttgaacaatgagaacatgtggacacagggaggggaacatcacacaccagggcctgtcggggagttgggggctaggggagagatagcattaggataaatacctaatgtaggtgatggattgatgggtgcagcaaaccaccatggcccctgtatacctaatgtaacaaaactgtgcgttctgcacatgtaccccagaacttaaagtataatttaaaaaaaaaaaaagagacaggctgggcacggtgtctcacgtctgtgatcccagcactttgggaggctcaggcgggcagatcacgaggtcaggagtttgagaccagcctgaccaacatggtgaaaccccgtctctactaaaaatacaaaaattagccaggcatggtggtgcatacctgtaatcccagctacttaggaggctgaggcaggagaattgcttgaacccaggtgacggaggtcgcagtgagctgagatcgcaccactgcactcagcctggcaacagagcaagactccatctcaaaacaaaataaaacaaaaaaatggttgctgatattgactatgccagattagaaactgaaaaatgaagaggtgaatttcatccttaaagataaggtttaaattttaagatactggtatttatatgagtaatgaaagaattggtgagaaagtaatcccatctaattcttgtcttcctgatcagtggttagtcaagaacaattggagaaaaattcccaaatggagcattagaatcttggctcaagttataacaggtttattgcatatgatatagaaagcaaaaaaaaaaaaaaactggcttttaccttttgtttgttattttaatacctttagtgtaggtcatccttcacttgaatgctaatgttgacagtaacttgaccttacacttaagtcatctttttgaatgccactggacatttggctcttggaagatggtaactcttagtacttctccctggtttgtatatattacttatttgggaacctatctgccattgtggctgtcagagctcagcataatttaaatgtttaaggagggtgattgaagtacttgaatgagatatcttttcatctatctgctgatgactcactaaagagtattttgaagaaaggatgttctccaactcaccagtgtattagaggaaaaaaacatatggtatatccccttaaaatttaagtttttagaaagcagaaatgcattattccagtattactgtgaatacttatattaccatagaccatccccattgtaaggtacttatctttttataaaatgtcctaaaatgggtaaattatttcataaaaactggcatacaaagttgctctaattagaacgtaattgtttttagacttaaccattaattgaggctgtcagtagtttgcagcagaatccaagcatctactgtattaaacttcatctaaaaccacgttattcttgatgatattttgttataattgatactttgttctttgatgcttgagagattgtatttgcaggtaatacttttatctaaaaattaagatgaattttctggtttcagagtattattttgttaatgtctgctgttgcccttcacctctctgaaccctactgatttttctagatcaagctaaagaatgtcaagcttgatgaagttttcttctatctcaatagcttaaattatggcatttggacatggtttatagtatctatttcctttttccttgtattagttagctgtgtaatagttatgcctgcctcttatactggctcctagagagcaatgactgtgttttaggcatccttgtagcacctttcacagtacatatcccctatattttcaggaagtatttatgaaaaccattggtttttatcccggattttccaaattagacttacaaataagtcagtaatttgaggtttaaatgagtaattacacagttagccataatggttaaggctctatagttaagattgcccaggtttgagtgcctgcttcattatgtatcaactgtgagactccctcatctgtaaataggaatgttagtatcagcctcctagaattgttgatgaagactaacataattagtttgtttaaaacatttattgagatagcaaacatataggatacactcaatataatgtagtagtagtataatataacttttgctaaatgtagtcctattgggctggcctgtgagccccttgaaggcctgtcttttggtctttatatctcaggcacctaacctagcagacagtcaatactcaataaatacttgcttgaattgaattgatttatttaccctatttttatcttccattacagcccactgtttgtaacatggaagattggtcgagacaaaagattacgtggatgcataggtactttttctgccatgaatttgcattcaggactcagggagtacacacttaccaggtgaagaccaatttttgttacctctgcttttacattaaaaaaaaaaacttatgaaacttgaatctgatactttaactccttttactgaattgtcaacgttcttgtcttccttcatgtcaggtttttcctttgtctttaaccatttaccttttctctggtaaaatgttattgatatatattaccataatataaaatactgtgattaatgtattctgccatcgatgttttgaagtgttttttttttcttccagtggccagcttattttgtataacttgaaaaccaatgaccaaatgtccacgggttaccaaaatatgtgatttctatagtaacagtcattatttcttccctcttgtgttttttaaaaatagttgttgtctctttcatcttacacattttgttacacttttaaggacttttgaaattgaaaggagagcctaggaagaaagtgatgccacagcctagcagtataatcattcacattcacacttcacccagaattaattgtagcttgcttattttcttttatctaataaaaggacaaagtaattcctcattacagttgtttaaaactttgttcttaatttctgaattcacaaaaagctatctagcacacaatgtgaattttttggttcaagtttagatttcaagcaaattgtgacccaaaattatttcaaaagaagaaaattccttaaataataagctattagtaaaggaatttcctgtttttgttcacattttagggtgattatctgatacagtttctatagttgtaatatgcacagtgtctgtccaacaagaaattgctccctgctgactattggtacttggggcatgtttctcaacctccataggtaaaatagtaattacagtattttgttctatatacttaatagaggtgttaggagaatgaagtaataatcactattttacttcaggattaatgtggaacattattttactgtagaactgcataaatgcaggctcatagcaccagttaataaaatactgtaactgagtttggtattctcatatttgaaggtatgcagtagctcacagctgcagggttttctcagcttacagtgaagcccagaaaaaaaaccaatggcttgggggatcatattcattttttagcttttcacaggtataagaaactgggtgtttggatttgattaaataacatacaggctgtaagggttgaaacacatattctggaaataaattcaacttgttaaagataatataagtactagtctaggcatgttagattttttttttctgacataaaatacaatgggctcatttttgggacttcagcaaattctgccaatggctacctttttgggacaggtacatattaaattacacatttaatactaatcaatggcaatttattgtacatttcccaaaataagttgttatgaggaacactggttcctttgcgctacctgaagaaaagaattctgtgaccaaataagtttgggaaacactggttaaaaaatgtaaacaactctgctcactgtaggacttctcagaaccttttatgttaatagtgttatgtatatctaagagagagaaatagaatgtagcattttccaggcttatttgactacaggacccttttatcctcccaccccaaagtctgagtgttccaaggaaaacatttttggaaacacaagtctgttttcaaaacagaatattactttatatttgggtagtaagagttggtattatagaaaccctttgtgctttctagtgaaattgtagcagaaatcccattatcaaacattatataccttagaaatctttcgtagtggtcattgtggtagcaattgggttttgtttaaagaaaaaaataaattcttttgccaatgttggcaaggggtgaaaacatccaacttttctggacttgtccatttatatcctagggtaatgaccagaagaattacagtataattttctgacaataatgtgattctgaatgaattgttcaaatacttgaagttggaaatttgcctacatttgtataccttgttaccctcattgcaatctatagctcttcctgtttacttttcatcttttttctcatgtttctatacagcttcctcaaattgtatatatcacattaaagaggcgtgtgtgtgtgcgtgtgtatacatatgtttgtgtgtgtatacacacatgcacatacctggttttacttctcatttttgtttggcttaatttcttttgtataacaagatattaacaatcatactatttggaaaagatgaacaaaagaaaacaagtcttacaaaatacaattaatcttttttcctggattcattttagcatcaaaagttgtaaggagtcatttttaaaagttggaatataatatttttctgttcagtagtgtgcttatcatttttacgtattatgttattatgattatttttgttaatggctgccatttattaagaatttactatgtcagacattgttgaggagctttacatgcatagtccttgtaataacccttaggtactaatatctacattttcaaaatgaggaaactgagaattaggtaatttaaataatttacccactcacacatctattaagtgatagaaccaggattcaaacccagagcatgtgtctacaaaatccatcccctaaccgaggcaaaattttctgattatttatgttttgcagctttgtcatgaaaataatgaacttgaaagcaagttactataaattttataaatcatagatcagtaatccttcaaaaattctagttaggagttaagactgaaattttgcaacaggaaaatccatagatattattatggaaagtatacaactcagagttgtatagagcagacagaagaaaattgacttgaactaatattgtattaaggataaagcttattacaaaacaatactactgtaggataggaaattgtattctttggctacatggactagactttaagaatacaattttttttgaacataaaaattggtgattcttggcttctggtcatcccaccttaaaaacccataactcacaaaatgaataaatagaattaaatgaacttaggggataggggcataaaggagggagaaagcaaaacaaaaaacaaaataaaacaaaacaaaaaataagcagtgaaattaaaggcattctaggtataggcatctttttaaaaattcaaatatccggttcatctgtgattagatagactattgtttgattttcagaatgttactcaattatatctcttctttttttttattgtggggaaatatatgtaacataaaatttaccattttaaccatttttaaatgtatagtcctgtggccttaagcgcaatcatgttgttgtacagtcatcaccaccatccatctccagaacgtttttcatcttccccaactgaaactctacccattaaacatgaactccacattcttcctcctccaggccctggcaaccaccattctactttgcgttgctatgaatttgactactctaggtacctcgtatcagtggaatcatatgatatttgtcattttgtgactagcttatttcacttagcataatgtcttcaaggttcatccatgtggtagcgtgtgtcaatttaccttctttttaaggcagaatatattccattgtatgtatataccacattctgtttatcctttcatccattggtggacgtttgggtgggtggcttctaccttttggctgttgtgaataatgctgcgatgaacataggtgcacaaaatatctgtttgagtaccctttttcctcttaaaagtgaaccagtttatagaagacaatgatctagcttgtgtgtagtcccttaactctaaaacctttcttaaaaatatgaccagatattttttaaaatgaaatgcctatcctgaattaagtttttatttataaataaaattataaacttttaattttaataaaattatttaaacttttagaattaaagtacttgtcatagtcaagttgtatgttcaaatatgaccgggtattttttaaatgaaatgcctatcctgaattaagttttttaaatatatatataaacataatcttttaaatgtaaagtacttgtcaaagtcaagtcatatgttctcctaattgaaattttgattttagattgaaataaaatcttataaagaggctgaggatttcttctcaattgtgaaaatacatagtatttgtgtaggtaatgaaaagtttatgagaagtacatggaactattataaatagactattctttgtctgaccttgaaggatctgggtaaaagcaggaaagattatagaaaatacgaagcaggatggagagctcagaattattgataaaagtctatccatagaatttggtgataaagtccacaaattaccctatttatcattgctcaagacttcaaagtagaaatattctttgtccgagctgaaggagataatttccagtattgtgtttatggcttttatatattagaaagcagaggcagattcatttccccaattttagtacttagaaaacatacttttatagagaggaaaattaccactaatatagatgaatataaacatctcagtcaaaaaagattcctggccgggcgcggtggctcacgcctgtaatcccagtaatcccaggccagcggatcacgaggtcaggagatcgagaccatcctggctaacacggtgaaactccgtctctactaaaaatacaaaaaattagccgggcgtggtggcgggtgcctgtagtcccagctactcgggaggctgaggcaggagaatggcatgaacccgggaggcagagcttgcagtgagccaagattgcgccactgcactccagcctgggtgacagagcgagactccatctcttaaaaaaaaaaaaaaaagaaaaagaaagtttccttaaaattttggctaataaatttcccagcaaaatgcagatctatttctttatgtaaattcaagttggcagtaatttttctagaacacattaagtaattaatagatgtattcttattcagcaaaacaggattgtggtctgtcaccacacttaaaagactatctttttttctcctttgttgtacttagacctctcggcagtgaaataattatgcaggtgctggcagttctagaacttgattgtgaactatgccacttttgttgaactacttaattctaagaaattagcaatgaaagtttagccctttctagggaacagtatgaccacataaaaggtgatgtgctgtgttttgttttggagttttattttgttctgtgtgggttagtggggttgtgtgtcaggggagtttgaggggggattgattgcttgcatggtacaaatattcactttccattagattttttgagatactgaaaatagctaacaaacctactttattactttcaaaggtcctagctagattgggtacttatgggattcattgtaaactgaatttgcttttatattttggtgttgtaatctggcatttttctaaagcagtatgagtttaaagccattataagcagcataatattttccctgtcatagtagaccatcgtgtgatcatttttattcttgattatttgggtaaccactctaggctcattgtgaacacttagattaaacaagttcctcctccctctcatttaatattagtctttatggtagcatcacccagattgatttttcttatgaaaagaaaagctgtatgaatcacctctgactgtacattattgttatggaagctcattctggagatgttaaggccaaacaatttttggcaagtggttgtggcaagacttctggctaaagtatgcattttggggaaataaattagatgtatcacaaacaatgcaaaattaattagtttaatttacaacctacattttttgcctttttataaaagagatgatggcctgagtcctaaaacttatacctaatttgatagtttcagtttattaattacaaaatgagaaacatttgtcagattttataggcacttaatttaaggtacagtttggaacctaggttgttgtacgctctttactcaaaattatccacatgaagcatggtgaactatctgctcaaactggaatcctcattttagccatgaggttaatgcactccttcgttatcccaaggttgtgctaatgtgcagagatgtagccacaaaattcccagcagaatgtggaaactaagcagcaggaaccatttgcagaatgggtaatggctcctgaattgtagagaattgtctgaattcatatagcacctactgccacagaaattaagtgtagtgagtatatcagattctaattccttatcacatcatttagatctttagagtttccagttggaatctccctgctgctttgattaagagccacaggcaaaatgcctggggcagaaaaggccatctgtgaaaaggtagtgttgagagaagctgaaaatgggctttttcagcaccagggctcttggttcttaagtttgatagggagagagtgaactataagaaatttaccctatttttacatctatctgtaaagtttaatacctctctggtccttcgaggctgtttccccttttaatcatgtttaaacagttcatcctgcaaatcttgtcttaattttgccttaggagtttatgatatattaggagagataagaagttatcgaaataattgtagtcctaggtagaaagcagtttttctcaagaagcagaggacgtgatactggatgattactactctatatctgttataaaagctaaaatgtatttaaaggtatctataaattattttatttggttcatccctagttcactttttataaaagcaaaacagtatgtaccactttctggcttgtttttatcctacatggtccaaaaaggtcaaaattatagggatgcgtgtaaatcattattatcaaagcaaccatatacaaggtgttgggtatttatattttaagaaatttgtaatacatattttaaaggggaaaatgatcttgtcatagaagaaaaagcctttgaaatagaggactcttaagagtgtgcatgcacatgcacacatacacagggagtttaccaaacattagctagaaccaagttggattatagctctgatgcttggcaaatgaagaaaattaaaagttatagtttagatttcactttcctcttgtcttgttaaagtgaattcatattttgttttagtacagtaaactgatatctgtctcctttcctgagagtcattgtctgcgatagtcttcattttttcagatgaatgactgaaatggtaaagctaagttagaacacaaatattgtatgaaattattacattggatgtggcctaaaattatactatagacattaaaaatatatttcttttgtctgaatatttacataataaatgttgggcttacttataagtgtctaaagtatttgagtcattaggacctgaatgaacaggaggacagatttgtatcttagtgttctggaagaataagatggttatgctttgatgtaactaaaggtgattatcatgcaaatcctatgcttttaccacttttaaggggacaatgttaggaatttgagtactttaaaataattgaaagttgaggttttggtgtagcaattgaatattaaaattttagttatgatcttatgagcatgagaaatactttttaaaagtagaaggcaaaagaaatgaagcccttctctgtgatctttcccattctctcaaacttcaaactgccttaaatgtggttatccaaagtagtagtccttggaaaaaacttacttttcatcattgataacaatttgttgatctttaaatgctaaacacttattgcatcgtaagtcctttatcttgcatcataaatatatttttcttagaaacaactctagtttttcttacattctctctcaatttttaaataaagagcaaactttcaacataaaagtcctgtcctaaagaactacattatctgatctacttcttgttaacaaaagaaataaatatatctatatttatataacaaaatagacatggacaaattgtaacatttaaaaaattttctattggaatagaatatcatagatgctaggaaattctaaagatggaaaacaatatagtcatgtaccgcataatgacgttttggtcaacagtggactgcatatacaacagtggtcccataagattataatactttaattttactctatcatttctatgtttagatgcacaaatacttaacgattgtgttacagttgcctacattatgcagtatagtaacatgctgtacagctttgtagcctaggagcaataggctatatcatatagcctaggtacgttgtagactataccatctatgtttgtgtaaatacactctatgacgttcacacaacaatgaaattgtttaatgatgcatttctcagaatgaatccccaccattaagcaatacctgactgtatttaatacattcttttgagaatgaagctctaattattgttaatatcaaatatgcagtgtacttttcagtatatttaaaatctgaaagtgaagaaaatacatttggattcataaggtacagatttacacttggtgtgatgttcagaaaactcatttttgttaattttacttcagctcaaaaaattatcctgtaaatctacatatggaaactatagacttattcagattagattagcatgttattgtctccatttttaacactctgttttttttatttctacatggaaatgctaacttttgtatccttcctagtagtgaaagagaaagttagaaaaggccataaaataaattcttcagaagctttaattaaagggattgcccagaactcaacttcttgttgctatacccaactaccttcaggactactttgtatgttctacaaagctgatttaaaaggttccaactgcagtcacttcactgaggatggcaggaaagagaatctcttaagttctgcaggctgcttttaacctaaaccattcttctaagatgaccattacttgcctcctagctaagcctggagaagtattttaagcctttgaaatgagtggagctgtgttgcatatgaagaacagtaaacaactgtacactgctggttagacttgtactgctaatgagatcatgggttcaatccctatttggaccatatttttagacaatagctaccactagatcccaggcgttgattacagtggggctcagacagagcacgtgggcgaatcagtaccaaacccaagttttagcatcatttcagcatatgaaacgtgctacattaaaagtacccaaaacaatgtggtcttaaaatgtgatatacacaaaccctttgaaagtagcaagacagacatgccctttttctaaaattgacaaatcccgaagaggaagaaaagagttgggacaataaaacactggttctggaatctggaatgttgctttaagtccaggccagcagtgacaaaagttattgtaatgacctctgaacagacagacactgccattgagcaggcctctggtatagaaaacatggtacatttgggagttgtgaatatagctccaggtgtgctcctaaatcagttcacagtagattatgcttaacaacattgagatgttattggaggtgtggatgaggaagtttgttgttgcagtccttttttgcaccttattttaaagaataaatgaaacatttttctaattcccttttaaaaaattttaaatggaagggaagtttacttctgatgcttcagtgttgtaagttcaacatatagactgtcaacctaaattcatggtataacacagttcttttcttttttctttctttttttttgtatctgttcaatgaaaataaggtacaacccaggtttttacatagtctgactagaagtattccacttcaagatctgagagtagcattttctcaaactttcaccttaaaaaacaacatcactaaacaaaaactatcacacagaatggataagaagttttgtagatctttttggtgatgaactatgacatgagccttatagattgtaaaatatagttgaaactaatgtacataatgaaaatttttaaattttatttgctgttaaattctgtgaaatttcagttatttaaaataaacatgcaaaaatatgaaatgtaatgtttcagattgcaaggtaatatgtaatatgtttgtaagatactctggtctaatactaactagtagtatttggatttgtacagtcataattcattaaaatgacttcattttaacatgtaccgatgtagactaatattgtaagttctgatttaaagaatggtgacaaaatggcgcatgtaatacttttgcaagtgttggggaggtcggtatgttttgaaaagagtaatttaacttttgggtgctaggaaatgggttatctcaaagaccattgctggcaatgggcaggcctggtaatactggcacagagcattaatcatacaccttattaacggtgaggtgaataactttgaaataaagttttagggaagaaaagagactacccaaaacttagctatctcatgaacagttgatactaattataataataattgctttgaatctaaaagaaaaaagaatatttttagatgttaatttttcttcacaaactctttgaagagtgtcaatgtgacattagagaaaaggtctttggagtggcagtagaactgacaacacaggttggacttcagcaggcctgaaaatggtatggccaaaaggggagatttctttctgcctctaataaagagtagtggctaggaataggagtcatctcagatgatactggatttcagctgaagcaactcttaaatatttcagtggtaaaaggatgactatgttaaattcatgggtttgtaaatacatgttataaaatgtaattgttctttttaaaagcacatatttttttaaaagcctacattttaaagttgtcatctattgtgtattgagatgttcctgtgcctcacagatcagctcactaaggtgtggtagctattgtctaaaaatatgtaccctctcatactgttgcagcttcctcttcataggctttattattgcccagagcagcacatttaccccattagccaaaatggcacaaacaacgcccattggcatgactgaactctccttagttggtgtcaatccttatatctgagataagaagctttcctgtgtctacctttctcacctagagtaaaagccaaagtatttaaaaaacatatatttcactcagagtaaagttaatgttctgcaatgaatgccaccatgctcagcttgcccctctcacctcatctcctactcccctcttcccacctccattcattctcttggccttagctaggctggtttccttgtttccctttgaacacaccaagcatggtccccgccaggggctttgcacttgaattttctttacttgcaacagtcttctactagatagacatgtagcttggcttcctcacgcccttcaggtctctattcaaatgatgccattatcattgacacgtatgtaaaatagcaaggcctacatttgatatctggctctccctgcccgtttaccctgcttcatttttctccgtagcacttatcaccacctggcatactgtaaatttacttgtatatttgtgagtctttcttaatgcgaatgtaaattccatgagggcaaggactgctgtaatattcctcaaagcctacaacagtacgtggtacatagtaggcattcagaaaatattagttgaataaataaaagtcttgtttttatcagcatttagaaattgtggattataaagtataattctttgtcttactactttacctagatgtgaaattatttggtcttattgtggctagtttcttatagttttcattgagtgcatattgaatgtattttttgtgtgtgtgagtggtttgacattaaaattctcttttaaaactcattttatcatgaacacttttaaatactcgcaaaaatagactattataatgatgcagtcatttttataatagtgattttttttctcttttctttttgtggggaacagcgtctcactatgttacccaggctagtcatgaactcctgggctcaaacaatcctccagcctctgcttccctaagtgttgggattacaggtgtgagccaccatacctggctgctttttcattttacttatttttattttaatacttgctttttaagtacagaggcagtatgaggttgtagaaagaggtagccatatctgggttctagttgtgaatccctcaattcttagctttgtgacccaagggaagctactgaatttctgccatgtcttggttttctcatctgtaaaatgggtataattctaaactggtaagtttgttgtgaggattaggatatatatgtatatgaagtatcttatacatactaggtacgtagtaaatatttatattgtagtacatgcatagtaaatatttatatttctgcttcaggaagaaattaagtagtgagaatggccaagaaatgaaattttaaatatatttatagcaatttcagtttttctttttctcttggacacatgtaggtaggcaggaattttcataatatgagaagaaacaagcattatcagtaaataaaccagtgaccccataatcagtcaccatcacatttctgtttatgtaattctttaaaaaatacacacatacatgtaactgatcattgagcaaaacgctatcagtctatatttcctgttggttctgccccacagatatctcttgaatccaccccatcctcttcagcctcactgccactgcctttgtctgggttcttattctggctcactggtttccctgcttccctttgaagccattgtacaccaatcaccagaattatctttgttgacaaaaatctatctcactctccttaaaacagtgcctgttattccttatcaccagagaggaaaacccatttttattaagaagcatagtacttgaggacctaacctcacactccagccatgcacacaattattcaccacttcccaaatatattctttcatgtctctctggcttcacatttttttctttgcctctccccatttccacccagtcaactcctacttatccttcaagactcagcttgctcattgcttcctctgtgagatttccttgacagtccccaggaaaattggtcagtctcttttaggcctctattataacacttaacacactggattataattattaattttatgtttgtctctcccttttgaaattgcgctccacagtagtttaccaagcaacatcaaagcaaactaacaaaaaccagtctcattgctttgtagcaactttgcttgatcctgataaccattctactctctttcttttctgtttgcatatgttagcttatatctgtcacctcttcttgctgccagcatacttgagccagtaagagttaccagtgttgattgatagtgcaaagggtggcttaaggccacttggaattagactgagccagaggacagggatctttatacagaacactttagaaaacaaattgacatgaggttgatctcattataagtgactgaagatgcactatgtgaattgattcctgccatggaaccatagacctagaagagattcttttaagtcatctagtccaacccctatcagatactttaatctctcttaaaaatctcctgagtaatgggcatctagcttctatctgaacatctctgtagacttggaagtcacttccagttaagtagcccatttcatttcaaacacctctgaactctactcccataacttcagttaccacatagttttagtcgaagtgctagaagtcaaagattgcctgcaattagcactttattctttatagaaagctgcattaaccagcagtggttaaacttaaccctccgagtaatatctgaattatctgagtctttaggagtttaggagtagtaagataacacagctttacaattgagtctcatccacccacccatacaaattttaactcttcccttattgttgaaacctttgaagctactgctgccacaatatctctcacagtctaccttagacttctggagttggctgaaccctagagcccagagattccaagatagacctggtgctagatcttttagtgatcccaacaatgtcacagagttggaactagagttagaacacaggtctcctgacattgccttggactatcattacaaattccagaatagaaagtacccatattatatgtgacttgatgcttaaaaaatgaaaaagtacccataaaagtatatgaatttgttaattttagttaagaagcatacaatttcaaggaaccctgtaatgaaatgatcattttgtaatgtaaagatttattcttgagttatctgccttgtgtcaagtttaggcatacttccataaaatgaacaatacccttagaactattcaactgcaggagtaacaatatcagagttagagaatctcaaagcaaaaccttagatttcccctttcctttcctttccctttccgtttccctctcccctttcccctttcctttcctttctttccgagtctcgctctgtcaccaggctggagtgcagtggcatgatctcagctcactgcaacctctgcctcccaggttcaagcgattcttccgcctcagcctcccaagtagctgggactgcaggcatgcgccaccatgcccagctaatttttgtattttcagtggagacggggtttcacaatgttggccaggatagtctcgatctcttgacctcgtgatctgcccaccttggcctcccaaagtgctgggattacaggtgtgagccaccgcacccagccagatttcccttttctttaaacatatctctgcttgttatgtgtcccaatcatacttgtaacttctgttttgtgtgtgtgtgctggaactctcgtaggtattttatataagttacctcatctaatatttccaacaaccttatgaaggtgaaagtatttcacttatattgcagttagggaaaacaaggtcttagatggttaagtaatttgctgaatgacagctaataataacctgattctatctaattccaaagcctgtgctcccaaccactgtgcgatactgcttccttccagtaatatcactcccccttccctggtgaaagcttcttatggacatttgtttcactgactcaacaggtattccctggtgtccacttacagaaaaaaaaaaaatcactgaataacctttctcttcatttgggaactcagtttcttaactcagttttccaaaatctcccttatacccctagtccattaattccagtctcaacttctcttgggttctctttccttttagaatcttgaggcactgtctcccttaatatgacttttttcttcacagctatcctcccagttcagtttggtattctgaacttccatagtcccatcagaatttaccaccttctcagggatacatactccccaaactgatttctttctacatttgatcttagccaaaaggccaagaagtgattgatctctttctgtacaacatttgcacttaatatcagtacatttacatggaatactagtttagcccttagattctagccagacacaactctctgaaatccactgctgactagagagcctcgggggaaggattcaccataaaggaactgtgaataaaagtcctgactcagctattctcttcaactggccaaaaggtagacatttaggagttaagaagtgagacagttccttagaaattataattaaggaaacaaattccaagtttctaagtaattaagaccaaatatattgtcttagttttaatttttgcaatttgaagttccttaggagcagtttttgatagaacaaatgatcataaaacagttagataagtggcagacaaatatatccgtgactggtatcaggaaggaattgaaagtatgtagtcgtggactgtgtccatcttattgaacttagatttcttacaatagtaaggtttaaaaaaacaataaaattctccagattgtatttttttcttttcttttcttttcttttctttttttttgagacaggatctcgctctgtcacccaagatggagtacagtagtgcaatcacagctcattgcagcctcaacctcccaggctcaaggaattctctcacctcagccacccatgtggctggtactacaggtgcataccactatacccagcaaaatttttataatttttgtagagacagggtttcgccatgttgcccaggctggtctcaaactctaggctcaagtgatctgcccacctcagcctcaaaaagtgctgggatttcaggtgtgagccaccacggccagcctcagattgtgtctttttcttaccacagctgggatttgaggatctcagtatttaaaaggcaaagaagatttttagaatgtgctttctgtagtatacaagtattttatgatgcattcttttaaaattctgtggcaaacaatagtgaaaactttagaatcataggcatcattcattatcttctattttgctcctgaaccatttaaaaacttttctttgtctgaaacaagtattattggaaacctgttatcaggataggtatttttaaatttgacagtgaaaatatctttcaaacttgttttcatatactgcctgttaataataatgaaattaatgaattaatagccaggttggttgggacattgtccatgtcacacgtgtttctttctttcgtttttgtttgtttttttttttttgagacagggtttcactcctgttgcctaggctggagtgcagtggtgccctctgggcgcactgcaacctgtgcctccagggctcgagtgattctcctacctcagccacccaagtagctgggattacaggtgcaagccaccatgcctggctaatttttgtattttttgtagagacggggtttcaccatgttgtccaggctggtcttcaactcctgggttcaagtgatctgcccacctcggcctcccaacgtgttgggattacaggtgtaagccaccacacatggccaatttttgtattttttgtagagacggggtttcaccatgttgcccaaggtggtctcaatcacctaggctcaagctatccacctggcttggcctcctaaagtgctgggattacaggagtgagctatcatgcgcagtgctgggattacaggagtgagctatcatgcgcagcccatgtcacgtgtttcctaataggttttcaaagaattttgccacagtaagaagtttttatttcacatattcaagtcccacatacctgatcatggcaaaatggcaaattaatgatgtagttgaagagaaaccagcaaagagctgtagatgctagctcagaaatgagtaacatttttagtctttgggatgtcagtgatggtgcacagtgtatttaagtgtcatttttgtcataagccagagaagcaggaggaaagagtaatgggacatggtaaagcagaaattctgctaagtagctgaatgttagagttgattgctgctattctgtttcttgcctatagtgtagcccattttaagttcaagactaagaaaaccctccaaaaagtttaaaaaattcaaagcaaataaactagtaaatgctcatggctctacacttttacactgcagatttcttctatttcccaaaggactcacccagtgatgtttcctaactccccagagttactgtttcttcccttgtatgttcataacacattactggtatctctgttacagcacttgctttatcttgccttccaatgtagtttcttacatgattgtctttcctacttagattggtagtcccttgaggacctgaactatatttttcacatctttgcatcccctaagtagctatgagggattaggcatagagcaaaataaatgtttgaataggagagtcatttcccctagtatactgaggtatttgtttactagctgggtaagataattaaagaaagtgttaggagccacagcctatgcaaaggaagtgagaaatgaagattaaagcatctctgaaagtataagtcataggaaaataaaattaatttgcaaaggtgatttacttttatttttaggaatggtgagatgtatctgcattttgttttctatttatagttttaaatcaaggaaatttttactcacttgttttataactggatcagttttcatttaataaaggataggaacactcaattcttatgggatatttagatattctaatcacacctattaagttgtgctattataaaaatgaaacagttgaaatacaagtttaagatgtgctcccatggaagaatctatatgtactaattgtacaaatgagatgagaaacagaaatagcctggggaaaagaaatggggatgctatttaacatcctatatattacttctagcagacaattgcaatttacaatcactttataagaagaggtgccatgagggctgcttattaaaattgttttatgaaggacattttattcacagtagcactactgtccatatattatttttaaatccctacgagagagatggtcatttttgtgaagtttcggttgtagttcctggtcctacaaaggtttagtgagtgagtgatggcttgtcagaaatgatctttctgtgatggctgaaaactttgggaggaccaaagtttcaggtgagcaatcctaggtcatagcttcacatcctgccatttattatctagttaattatgcttgattctgcttgatacaaaaataaaatttgcattcaacaaacaaaacagtacctcacctctttttcacaaagaagaagatttgggctagagattgggagattttgtatttagcaaatttttaaaagtccttttgagatgtgtcttctaagggcttttgtttgctatcattaactgtgggaatatttgctcctgaatggatcccaccttatgctgagcccagcttcccttgtcattccccctgcaataaatactatacaataagtgtctatgtaacaaataaacagtttggaggttaaatggaatgctcaatataataaagctccattgcagtagggagaaaagtccttttgatatgcatttgataggaatgtgttaatttcaacaaaacatctggtataaaagagttgtgaatgcaggacatttgagggggttacagaaggagaagggatttactgtgcttaacaattgccagtagtcaggccacttccaagttgtgattttgtcagacttagaaattaagtgggatcacatctactcagcccttcagtgggagaagatccaaatccagctgcagcaaggagcagtgactgattcagaagtagtgagctctatccagtgtctcctagctggttttcattaatatgcttactattgccctctttatattctggctttttaaaaaaatatggcctttgtggtttattggttgaacttgtacagctgaatctactgtaaaaggtcttttttcactggcattatgtcctacagatttgagtgttcttgctgttctatataagataattcaaacttagaatagtcactatagtttcaaagcttgattgaaagatacattcagtgttttctctaaatatgtagcaattataacaacacagctgtagttaaatacataacttattataaatcctgacagtcttccttctcatttatatcaggctgacataaggtttagtcagttcaattccacatttatcgagcacttaactctgaccatggtactgtactaggtactatgcagctacaaagatcaacagtacatgatgtctgtgctcaagagctgagtgatgtcttttgagggaaattggcatgtacacaaaataactgcattagatgtagaaacaatgctactggaagtgggagaaattagctctagttggatagattggggaaggttttactgactagctgacatgtaagccgaacctctatggacatatacgactcaatttcaacattcaaaagtggggatatggagaagatattcattatgcatccagaaaacttcctgagccaaatgtaaggagacagagaaatatatatgagaagagaaatatatacaagcagcccaagttacatccctgactattactattaccctgactcgggctgcttgtattaatatataggatggaatggaaaggatagagattagagaagcagttatgaagctaatcttaaatattccaaatgaaagatggtagaggcctgaattaggttagtaacaggagggatgtaaagaaacatataacagagacaaggtagtaattgaacaagatgagacttgtggaaagtaagctaaagggaagagttgaagatggcttcaaaggttccttcttagatgatggggcagggggaggatgataagatgaaaggtgataggcaacacaagacaagaagcacatttgacacattgtttgttaaagagtcatttttaatgtgaaagtaatttttaattaatcctagattatctttttctgaatttgaatgttgaagattttttaaaattaagaatttattgaaaattgtttgctttcaggatatggtagtgagagtgaaatagagtaatacattattatacattgtatcttattaaatattttatttaaaattaaaataaataaaatagttggaaaagacccttgatatcattattttctcttaggccatgccacaaagcaaagcttagaaaatacagctgaatcctcaaacttctttctaaccaaaaatacattttgtggataagaaatctataaagaaataaatgtttgtaaacattgggcggttgttatggaatttaaatatctgttcttattacctaagaatgtctgggtttcaaggctgaattaaaatagattccaggcatctttaaaggtaaacaacacatctgttgatttgtctagtacaatggaaactgactgaattttgattatgataaaaatcagcatcttccatctatttagcaatacttttgggtaatcttttctcctttggggaattttccagatgtttgggaatatgattccaatttacaagagttgtttttatattgtagctgagtgatgtcctaactatgaaactcttaggttggtgtaactgtatccaaagggtcctctgcaatgtgtgtaggaatgccctgtgacaccttggcttctttgacttgcccagactctcaaagctaggtggctggaaggtttcctggaggcagagtccagttctcattgtagtaatttacattaacaaaggaattaacatttccagctatcttctgggatcactcagttttgagcaacattcatataatgcagtgaaaatgaatagctagtaccacaaaacaatttagatggttcctttggtacagacgttgacttgtattttctgaaaggaagagaagctctgaaattcagtgaaaatgacagggcggttgctattgtacacattattagaaagaaccatttcaaataacaattgtaaacatgtattttaatgctaatatactgtaatagcctagcattgagtagtgaaacaatttcagacaagtgtccaaattgttttatgactacatttatttcttagtatttatttagaaaattagtagtcaatgcttagttttatcccagtatggattataacttgtataatattctatagaaaaatgttacctaactggaataactcagagctgcctccctctgccccagcagttggtttgtgccctatgtttgctgattaccttaaatatttgcccaagtcaagccataatttaaaaagcaaaattctcatttaaagagtcacaagcttagggtgtcaagttgtagatgagtttggacttgtgggccctcttgttcctcctgattaacactgatgatacagagatgacaaatatgattaacccagcatataaagagacataacatcttaaaagagaggagagatttttggtgactttcttggccaatactattttggagatttttttcccatacgaaacttactggctagcatttcacttttgttggaacattgacctatgattattttattcagtattcttgcataggcctttgaaaggatacctatcaattttattgtaccaaatgttcttaagaaaacacatttggtagttctgatattttgaaggtttctatagaaacaagaaatcttacagccattttttttatattgttgctctgatttacaattctgtatatgtaaaggaggagtcttatcacctcaaaccaagcaaaatttgtagagcaccgatgatgtgcaagttttgtgtcttacagtaagggaaacctgtacaaatccaggagcttacaatataattagagtagctaggctctctttgtgacaaggtaactaagactcctaggcagtgagccatgcttgcagagggagtggttgtggagagctggaagactgccctgtgctagtgaagtgagagccagtatagatgtgtgaggagtaacaacctccaggaatgcttcctttggacaatgatgctactttgttgggtttgcattagatatttatttcataatgattatatgtttagtacttaacttacaggtttccaaagaattttagctgttgttttggctttttattatgtttgttttttttgtgtgtcggtctataacctcaggggcataagccttttttcccttccccctattttacagctagatgtacccccaaggtatctacattaggtatttctcctaatgctatccctcccctaggcccccaccccccgacaggccctggtgtgtgatgttcccctctctgtgtccatgtgttctcattgttcaactcctacatgtgagtgagaacatgcagtgtttggttttctgttcctgtgttagtttgctgacaatgatggtttccagttttgggcgggtgtatgtgtccaggaatttatccatttcttctagattttctagtttacgtgcgtagaggtgtttatagtattttctgatgttagattgtatttctgtgagataagtggtgatctcccttttataattttttattgtgtctgtttgatccttctctcttttcttctttattagtctggctagcggtctatctactttgttaatcttttcaaaaaaacagctcctgaattcactgatttttttttgaagagtttttcatgtctctatctccttcagttctgctctgatcttagttatttcttatcttctgctagcttttgaatttgtttgctcttgcttctctagttcttttaattgtgatgttggggtgtcaattttagatctttcctgctttctcctgtgggcatttagcgctataaatttccctctaaacactgctttagctgtgtcccaaagattctggtacattgtgtctttgttctcattggtttccaagaacgtatttatttatttccaccttaatttcgttatttacccagtagtcattcaggagcaggttgttcagtttccatgtagttgtatggttttgagtgagtttcttaatcctgagttctaatttgactgcagtgtggttggagagactgtttgttatgatttctgctcttttgcatttgctgaggggtgttttacttccaattatgtggtcaattttagaataagtgctatgtggtgctgagaagaatgtatattctgttgatttggggtggagagttctgtagatgtctattaggttccgttggtccagagctgagctcaagtcctgaatatctctgttaattttctgtcttgttgatccaatattgacagtgaggtgttaaagtctcccactattattgtgtgggagtctaagtctctttgtaggtctctaaggacttgctttatgaatctcggtggtcctgtattgggtgcatatatatttaggatagttagctcttcttgttgcattgatccctttaccattatgtaatgcccttatttgtcttttttttttaatctttgttggtttaaagtctgttttatcagagactaggattgcaaaccctcccccccccgtttttgtttttttttttttgctttccatttgcttggtaaatattcctccatacctttatttgagcccatgtgtgtcttagcatgttagatgtgtctcgtgaatacagcacaccaatgattcttgactctttatccaatttgccagtctgtgtcttttaattggggcatttagcccatttacatttaaggttaatattgttatgtgtgagtttgatcctgtcattatgatgcaagctggttattttgcccgttagttgttgcagtttcttcatagtgtcaatgatctttacaatttggtatgtttttgtggtggctggtaccggtttttcctttccatatttagtgcttccttcaggagctcttgtaaggcaggcctggtggtgacaaaatctctcagcatttgcttgtctataaaggattttatttctcctttgcttatgaagcttagtttggctggatatgaaattctgcattgaaaaatcttttcttttagagtgttgaatgaatattggcccccactctcttctggcttgtggggtttctgccgagagatccactgttagtctgatgggcttccctttgtgggtaacccgacctttctctctggctgcccttaacattttttccttcatttcaaccttggtggatctgatgattatgtgtcttgggattcctcttctcgaggagtatctttgtggtggtctctgtatttcctgaatttgaatgttggcctgtcttgctaggttagggaagttctcctggataatatcctgaagagtgttctgcaacttggttccattctttctgtcactttcaggtacaccaatcaaatcaaaaaatatttggtcttttcatatagtcccatatttcttggaggctttgctcattccttttcattcttttttctctaatcttgtcttcatgctttacttcattaagttgttctttaatctctgatatcctttcttctacttgatgattcggctattgatacttgtgtatgcttcacgaagttctcatgctgtgtttttcagctccatcaggtcatttatgttcttctctaaactggttattctagttagcaattcctctaactttttttcaaggttcttagcttccttgcattgggttagaacatgctcctttatcttggaggagtttgttattacccaccttctgaagcctacttctgtcaatttatcaaattcattctctgttgttttgttcccttgttggcgaggagttgtgatcctttggaggagaagaggcgttctggtttttggaattttcagcctttttgcgctgttttttcctcttctttgtggatttatctagctttggtctttgatattggtgaccttcagatggggttttggtgtggacatcttttttgttgatgttgatgcttttcctttctgtttgttagttttccttttaacagtcaggcccctctgctgcaggtctggtggagtttgctggaggtccactccagaccctgtctgcctgggtatcaccagcagaggctgcagaacagcaaagattgctgcctgttccttcccctggaagcttcatcccagaggggcacccgccagatgccagctggagctctcctgtatgaggtgtctgtcgacccctgctgggaggtgtctcccagtcaggaggcacgggggtcagggacccacttgaggaggcagtctgtcccttagcagagctcgagcactgtgctgggagatccactgctctcttcagagctggcagcaggaacattcaagtctgctgaagctgtgcccacagccacccctttccccaggtgctctgtcccagggagataggatttttatctgaaagtccctgactggggctgctgcctttctttcagagatgccctgcccagagaggaggaatctagagaggcagtctggctacagaggctttgctgagctgcggtggcctccacccagttcgaacttcctggcggctttgtttacactgtgaggggaaaaccgcctactcggcttgagctatatttctgattcagttattagtgactgtaagatttatacttagagatctttgagcatgacaaagactgtaggtgaggatctagcaacaccaacatggaagtaaaagctctcaaattcacaataattgcaggaagcccagtatactcaataaagaatgaatgaaatatttatttaaaaagtagttttgcttgttttagtgacaccgatttgcttgtgttagtgacaacaataactcagaatgggctaatggagtgttaccaagtagaagtcccccagagacctgctttttaacatactacacaaaagatttgtaattatgatgttacagtgcctgtagatggttaattccagaatcctggaaataatttattctctttaagcaagtcctgtatttcccttacaaccttaattataaagttgatttgcttagcagacccttcttttccaaacttgctaaggaaaactttcagtctaggtctgtttgaattagcacaaattttgaaatagtagagttcaaattaatgaggttttattctgttatgaagagcttgttttccatcattgataattatttccaggaaagttaagtctgcagaaagcattctctcagtttccttaatgttgtttaccaaagtttaagaagtggtttttagttacatgaggggagagtgaggacatggcagtggcaaaggaaaatgaggtgctataacctggtctctcagatttgtggagcaggctttgagcagcattctaaaccaatattattccttgtaaaaggcaaaccagaccttggaattttaaagtctaatgtgattgagagaatgtgtgctggtgcatagtaatactttaacccccatcagtcgggtaagttgtaagaacctcttaggtgacaaataccctgacagccccacgaggcatgcaccatttccacccattttccctagagtcagcccttctcccactagataattctcattgcttcagagggttgattttcaacaagtcctccatccccctagactgcttactaacctgaaatcccacagagaacaggaagagtggccactggatttttttggaggatttaaaaaaatttgtgtactaatatctgattttctttaggcccatgttcatctaaagagtccgttatcttatgtttcttttttctatgcctgcccttgatgtcctgtgattcatccagttcataagatgttcctttataagaaggtgagaaaagcataaaaatagactagtaatatgggtccctatgtgtttcaaactgcaataaaatattattattaattgccccatataagaagcaatggagctccttcaggatgcagagtttatgtgtgttttccaggggggtgatagaggctgggagatcaaagcaattctgtaactttatcatggaattatgtttttatctatttatagcagtctatgagttttagatagaaaaatgttgccaaactttgctgtactttgaatgtacagtaatctaaagactaaaaagaacagttaacaccttctaaatgaacagcattaaataaataaaaacaggggaagacacacttcagtggaacagtttaaaaggatattttgaatgtaggggaacactgaccatttaataaagtataaccagtaatgccatttaatatttgttatactgccaataactttattaaatttgaaactaccttcctatattccttcattcattcactaaatatttatttaccagctactgtgtgctaggcactgggtatataatggtgagtaaaaatgagcacagtcaccatactcatagagctaaagttatacctataacatatacatggggataaagagtccaaaagttagtttttaatttggatttctatagggttttgcttagcctggtagatttctagagataggctagtatccatgaactttaagaagtaataagaccttgtgagtttaggtgtcttcctcttttttttttctttttttgttttttatttctggaatgtgacttagtttataagacttgcacttctcattaggtgctttgagtaactcgtataatatggtattgtagtgtagtaaaacttcaatgaaacaaggtgttccacagcattgaaattgaatgtagcatgctcctggatgtatactcgtgcttggcacatagcaggcactcaatacatatttgttgaaatagttcatgttcatagttatgccctcatatcagtaatcattaggactgctacttattcgtgaaaagttttgtcactatggggagcagagctgttatcacatgactgtaatttaaattgcatagattttatccattgcccttttctcttttcttttttttttctagtcctaactgctagaaatattacccctgaaggtatttgttttcttttttttttattatactttaagttctagggtacgtctgcacaacgtgcaggtttgatacataggtatatatgtgccatgttggtttgctgcaccatcaactcatcatttgcattaggtatttctcgtaatgctatccctctgccagcccccaaccccacaacaggccctggtgtgtgatgtcccgcaccctgtgtccaagtgatctcattgttcaattcccatctatgagtaaaaacatgtggtgtttggtttcctgtccttgtgatagtttgctgagaatgatggtttccaacttcatccatgtccctgcaaaggacatgaactcatccctttttatggctgcatagtactccatggtgtatatgtgccacattttcttaatccagtctatcagtgatggacatttaggttggttccaagtctttgctattgtgaatagtgctgcaataaatatacttgtgcatgatttataatcctttgggtatatacccagtaatgggatggctgggtcaaatggtaattctagttctagatccttgaggaatctccacactgtcttccacaatggttgaaccaatttatactcccaccaacagtgtaaaagcattcctatttctccacatcgtctccagcatctgctgtttcctgactttttaatgattgccattctaactggtgtaagatggtatctcattgtggttttgatttgcatttctctgatgaccagtgatgataagcattttttcatgtgtctgttggctgcataaatgtcttcttttgagaagtgtctgttcatatcctttgcccacccttcgacagggtggtttttttcttgttaatttgtttaagttctttgtagattctggatattaattagccctttgtcagatgagtagattgcaaaaattttctcccattctgtaggttgcctgttcacgctgatgccagtttcttttgccatgcagaagctcgttagtttaattagatcccatttgtctattttggcttttgttgccattgcttttgatgttctagtcatgaagtccttgcccatgcctatgtcctgaatggtattgcataggttttcttctagggtttttatggtttcaggtctaacatttaagtctttaatccatcttgaattaatttttgtataaggtgtaaggaagggatccagtttcagctctctacatatggctagccagttttcccagcaccatttattaaatagggaatcctttccctatttcttgtttttgtcaggtttgtcaaagatcagatggttgtagatgtgtggcattatttctgagggctctgttgtgttccattggtctatatctctgttttggtaccagtaccatgctgttttggttactatagccttgcagtatagtttgaagtcaggaagtgtgatgcctccagctttgttcttttggcttaggattgtcttggcaatgcaggctcttttttggttccatatgaactttaaagtagtttttttccagttctgtgaagaaagtcattggtagcttgatggggatggcattgaatctataaattactttgggcagtatggccattttcacgatatcgattctttctatccatgagcatagaatattcttccatttgtttgtgtcctcttttatttcgttgagcagtggtttgtaattctccttgaagaggtccttcacatcccttctaagttggattcctaggtattttattctctttgtagcaattgtgaatgggagttcactcatgatttggctctctgtttgtctgttattggtatataggaatgcttgtgatttttgcacattgattttgtatcctgagactttgctgaagttgcttatcagcttaaggagattttgggctgagacagtggggttttctaaatatacaaccatgtcatctgcaaacagggacaatttgacttcttcttttcctaattgaatacctttatttctttctcttgcctgattgccctagccagaacttccaacactatgttgaataggagtggtgagagagtgcatccttgtcttctgccagttttcaaaggaatgcttccagtttttgcccattcattatgatattggctgtgggtttgtcataaatagctcttactattttgagatacgttccatcaatacctaatttattgagagtttttagcatgaagggttgttgagttttgtcgaaggccttttctgcatcttttgagataatcgtgttttttgtcattggttctgtttatgtaatggattacgtttattgatttgcatatgttgaaccagccttgcatctcagggatgaagccaacttggtcgtggtggataagctttttgatgtgctactggattcggtttgccagtattttattgaggatttttgcattgatgttcatcaaggatattggtctaaaattctcttttttgttgcgtctctgccaggctttggtatccggatgatgttgaccgcataagatgagttagggaggattccctctttttctattgattggcatagtttcagaaggattggtaccagctcctctttgtacgtctggtagaattcagctgtgaattcatctggtcctggactttttttggttggtaagctattaattattgcctcaatttcagagcctgttattggtctattcagacattcaaattcttcctggtttagtcttgggagagtgtgtgtgtccaggaatttatccatttcttctagattttctagttaatttgcatagaggtttttatagtattctctgatagtagtttgtatttctgtgggatcggtggtgatatccccttgatcatttcttcttgcgtctatttgattcttctctctcttcttattagtcttgctagcggtctatcagttttgttgatcttttcacaaaactagctcctggattcattgatttttttgaaggggtttttttgtgtgtctctctctctttcagttctgctctgatcttagttatttcttgccttttgttagcttttgaattggtttgctcttgcttctctagttcttttttttttttttttttttttttttttgagactgagtctggctctgtcacccaggctggagtgcaatggcgcgatctcagctcattgcaagctccgcctcccgggttcacgccattctcctgcctcagcctcccaagtagctgggactacaggcgcccaccaccatgcccggctaattttttgtatttttagtagagatggggtttcaccgtgttagccgggatggtctcgatctcctgaccttgtgatctgcccaccttggcctcccaaagtgctgggattacaggcatgagccacggtgcccagctagttcttttaattgtgatgttagggtgtcgattttagatctttcctgctttctcttgtgggcatttagtgctataaatttccctctacacactgctttaaatgtgtcccagagattccggtacgttgtgtctttgttctcattggtttcaaagaacatttttatttctgccttcatttagttatttacccagtagtcattcaggagcaagttgttcagtttccatgtacttatgtggtattgagtgagtttcttaatcctgagttctagtttgattgcactgtggtctgagagacagtttgttgtgatttctgttcttttacatttgctgaggagtgctttacttccaagtatgtggtcagttttagaataagtgtgatgtagtgctgagaagaatgtatattctgttgatttggggtggagagtcctgtagatgtctcttaggtctgcttgttgcagagtcaaattcaggtcctgggtatccttgttaaccttctgtctcgttgatctgtcaaatattgacaatggggtgttaaagtctcccattattattgtgtgggagtctaagtttctctgtgggtctctaaggacttcatttatgaatctgggtgctcctgtattgggtgcatatatatttaggatagttagctcttcttgttgcattgatccctttaccattatgtaatggccttttttgtctcttttgatctttgttggtttaaaatctgatttatcagagactaggattgcaacccctgcttttttttgctttctgtttgcttggtagatcttcctccatccctttattttgagcctgtatgcgtctttgcatatgagatgggtctcctgaatacagcacactgatgggtcttgactctttatccaacttgccagtctgtgtcttttaattggggtatttagcccatttacatttaaggttaatattgttatgtgtgaatttgaccctgtcattatgatgtttgctggttattttgcctgttaattgatgcagtttcttcttagcatcgatggtctttacaatttggcatgtttttgcagtggctggtaccagttgtttctttccacgtttagtgcttccttcaggagctcttgtaagacaggcctggtggtgacaaaatctgtcagcatttgcttatctgtaaaggattttatttctccttcacttatgaagtttagtttggctggatatgaaattctgggttgaaaattcttttctttaagaatgttgaatattggcccccactctcttctgtcttgtagcgtttcagctgagagatccgctgttccctttgtgggtaactggacctttctctctggctgcccttaacactttttgcttcatttcaaccttggtgaatctgacaattatgtgtcttggggttgctcttctcgaggagtatctttgtggcgttctctgtatttcctgaatttgaatgttggcctgccttgctaggttggggaagttctcctggataatatcctgaagcatattttccaacttggttccattctccccatcactttcaggtacaccaatcacacgtagatttggtcttttgacatagtcccatatttcttggaggctttgtttgtttcttacttttttatctctaaccttgtcttctcgctttacttcattaatttgatcttcaatcactgataccctttcttccacttgattgaatcggctcttgaagcttgagcatgtgtcacgaagttctcgtgccatggttttcagctccatcatgtcacttaaggtcttctctacactgtttattctagttagccatttgtctaatcttttttcaaggtttttagcttccttgcgatgagtttgaacatcctccttcagctcgtagaagtttgttgttaccgaccttctgaagcctacttctgtcaactcgtcaaagtcattctccgtcccactttgttccgttgctggtgaggagctgtgaccctttggaggagaagaggtgctctcatttttagaattttcagcttttctgctctggtttctccccatctttgtggttttatctatctttggtctttgatgttggtgacctgtagatgtggttttggtgtagatgacctttttgctgatgttgatgctattcctttctgtttgttagttttccttctaacagtcaggtccctcagcttcaggtctgttggagtttgctggagttccactccagaccctgtttgcctgggtatcaccagcggaggctacagaacagcaaatattgcagaacagcaaatattgctgcgtgatacttcctctggaagcttcgtcccagaggggcagctgcatatatgaggtatctgttggaccctactgggaggtgtctcccagttaggctacacgggggtcagggacccacttgaagaggcagtctgtctgttctcagatctcaaacgctgtgttgggagaaccactgctctcttcagagctgtcagacagggatgtttaagtctgcagaagttgtctgctgccttttcttcagctgtgccctgcccacagaggtggagtctagaggcagtaggcgttgttgagctgaggtgggctccgcccagttcgagcttcctggctgctttgtttacctactcaagcctcagcaatggcggatacccctcccccagccaggctgccgcctcgcagatgcatctcagactgctgtgctagcagtaagcaaggctccgtgggcgtgggagctgccgagccaggcacgggagagaatcaccttgtctgccggttgctaagaccttggtaaaagcatagtatttgggcagggagtgtcccgcttttccaggtagtctgtcacggcttcccttggctaggaaagggaaatcccccaacaccttgcgcttcccgggtgagtcaacgccccgccctgcttcagctcgccctccgtgggctgttcccactgtccaaccagtccgaatgagatgaaccaggtacctcagttggaaatgcagaaatcatccaccttctgcattggtcatgctgggagctgcagactggagctgttcctgttcggccatcttggcaactcccattgcccttttttcatcctcaaatgaagctatttcctttctgtatctattgtggtgttcctaatatgtagcatagtacagaatcagcaattgccactatttcagcagcacattttgaagcttttccaacatattttattaccccatgtgcttatctcatggaaacaaaagtaaagtaggaccttttcaatgggagaattaaataacttttaagggtaatagaatggaaacctatacaagtaaaatttttctttgaaaactaggttcttaagatatgaccagacaagagatgaagagttaaaatgtccttttctgttttatcaggctaattttaaaaatgtttgttgaaaggagtaaagtaaaacctgttccaagttgagattggaaagtaggtttgcttaacgtatgagactttagcagtacatcaagaatcacatatttgacctgaactgaatctacccatgtcattgtgctatttacttgaaaacgaatgttgagattatcttgccctgaacaattttgtagttatacacgcacaaccagaacatacagttgcttttacaatagggacagattctctatttagagtttgataaaagagaaccaaatactctattttaaaaatgtatagcctttcccttgaataatcctttatgtagctcagcagctaagtagaaatgatgggacagaatggatgaactgcgaggtgagaccagcccctactaggagcgtataagcaagatgaggagggagtggagtggataagaaacgcagaggaagacaatagttaagactgcattctccacacacacatagtgttggtgctccgctgctcccccacccttatctgcttaatttataagttctgcttggcttcatcatgctgacacgtgccaggtgcctgtcagtgctgagttatgttgggcagctcactgtttcactgttttagctattccctggtgccctaggcatcattttcctctttgcatcttgaacatctgctctggagtgttattggattatgtgaaagaatgatggaaagatcagtgaattggggaagtcaggagatgtcactgatttctaagtagttttgtgactttgggcatgcagctttttgctcttagttatccccaaaatcaaatgaaggatgtagactagatgatctctaagcgcttctagctgacatttgcttgaccccatgactttagggggccttgttcttggaggacacctattatgatttctaatataatgtagtattagctttgtctatttcatggggctgttttgagtttcagctaggataaaagatgtgaagatgctttggaaactattaagaatcatataaaacaaaaatgatacgagtagtttaaaagattctttcctccaaagataccatatagtgataaaaattaaagtaattccatttaaatgaatgtgaggccaattacagaggccataagaacagacatgcagttatacttaccatagagaaatatgccatttaaaagcacacagatcaaggaatgattcaataaacattgattgattggttaggcagctaggctttggggatgaggtattctacttttcttcctgatcccccttgtgcttgtcaagtttgaaagaaacaggcagtggatcatgttcttttctctgtcactatcacccatccactccacgaaagttagaatagaacattaaaacctgtacagaagggaatgggtcatcttgacccaatagcagagtatgagaacatgaggccgccttgcatactggcttgtcagacttggcctcgccagcactaggtagcagtgaaggcagctgccgtatgcctttgtctttgtggtcctcttctcttcctccacccccattctgttctttcatgtccttcttgtgaccttttactattctttcttccttaccttactagagtagaaaagaggagcgcatacaaaaggtggggaaaaggaagaagagaaaggaaaataaagattaaaaactttacaatgaggtagtggggaaggttgggctcctctctttctctttctccttctcagtatgacggacttgataattttactttgtacctcatctttaagtttgacttcattcttttctttagttacctttagtccccgatcagtgacatatgcagaaaattataaacaggccgcatgataggaaccagtatcctgcctctcagcagacttgtatcatctaggactggcagtagttttagaaaggacagctgaaccagcctgacatgacacataagttagagtgacaacacatgttttgcagtttatagagttcaattaatagatttgattgccatggaaagagggaaggaaaagaattgcatgactcgtgtactgagtatgagagagcttattcatacaggttggaaaagcaaaattaaaaaatcagaaacaggcccaccagcctagatatgtccaaaactagtactttggtaacctattatgacttccagcagattaagtttcaaactgtggaaagggcttcggaataagggaaggcttagcatcccactaataaggcttattaagtttagataaaacagatgtttttcaatggtagcagctctgagtcaccaagatcaaaatggagaaagaagagaacaaaaacaagctaacactttcattaaaaaggtactatttttcttaggcattttcagaacctgctcacatttatacttaatactttcagttaaatcctatgaacggaagcattaattggggaaaaattccttaatactgattaaatgtatatacatttatgttgatttgctgacattctgaaagtggtactatgaaaagagaatgggatttagaggcaggcggtcctaatttcatatgtcagctctcttacctgtttttgtttctttgtttttgtttttgttttgagatggagtctcactttgttgcctgggctggagtgcagtggcgcaatctcaactcactgcaacctccacctcctgggttcaagtgattctcctacctcagcctcctgagtagctgggattacaggcatccaccaccatgcccggctaattttttttgtatttttagtagagatggggttttaccatgttggtcaggctggtcttgaactcctgacctcgtgatccgcctgccttggcctcccaaagtgctgggattacaggcatgagccactgcgcccgaccagctctcttacctgtttttagaaccattggcaagttacttaatctcactgatcatcactgaacctcagcttcttcctctacaaaatggagttgttttgaggactaaacaacttaatgcatgtatagtaccttactcacagtaggtacttagcagatattggctttctgagattttaagctgcttttgctcatagtgccatgtctaaatatcttaggaccagtcttctagagcttgatgaggagctttaggccatccaaagagggatgcacctgaaggattcattgtggggtgagataaaaatattagaaagtctatttatatcattttagataaaatataagaaagtatttaaactccactaatgtttaacatgtggattgaccctgatgctctcctttggtccatgttggagagtcactgtcatatactctaaatgagggatcccgagaaaagtgtgagatttcttgatttggtgagagttcatggtggcatgcacattcttttgctcactttaggcatattgtaacatatttcagtttacatgtacctagttaagtagatttctagttcttagtacaggttgagcatcccaaatccagaaatctgaattgctccaaaatccaaaacttttgagtaccaatgtaacgcttaaaggaaatacttcagatctcagaattttggatttgggatgttcaaccagtataatgcagatattcccaaatcacaaaaaaatcccaagtttgaaacacttctagactccagcattttgaataagggatattccaacctatataatcttcatcctgtggtttctttgcaggaatcttcttaagctgtttgactattgtgtgtaggtcagttaaagctagataaactaacccacgcagaatggacaagtggcttaggaagattcctgcaaggaaaaaaatgggctgatgataacagtgataatgcaagggcaagaaaatggtgaactagctgacacttctatgagtttcctcttaatttagccaagtcatgaagtgaaaacaaaaataatctaatcaaatctgacaagatgtcagccccaaaacaagaaaggatcaagagcattatttaatttatactcactgtctttaataacaaagcctactctaagtatcatgctttgatatattagcctgtcatagtagtacaagtatatactttataaatatacatattgaggatgtgtgctcaaactttttttagtgataagaatactcaatcaaaactgtttggatcctggtgatgacagacgacattgtcagccaatccccatgtggtagtgaggacatgtcctgcagttctgaagggattctatggattttttttaatttaaaaaacgaaaaactaattttaaaaaaaaacagcttggagactgctattttaaatgaggaaagcagttgctgcctatggaatctctcatctctcattctgtatctgctgcttagaaatcatttttcttgtttttgttttgttttgttttgttttttacctaaggattttgctatagtatgaatagtaggatagagagtaatatatctaaatccatcaaacatgatttagggaactttatttctgataaacatttcttctacagaagtaaaagaacaattcctgcccaaaagatttaaaaactgtagttcaagaaaactaagaaactgtttcaaagcagcatatgaatccctgcctgcagtataatggaaactcttgatgaagatgtaccttacttgatgtagatttgtttctgaaaaatatatatatatcttttttttatttctgtaaaactccctgtaactctgagtcagttggtaaccagtaaaccagtagcatattgtaaaacagatcttttcaaaaagagcgctaacctgctctgattattcctctcagcagtcctatagcatgattttaacacgtattttatacatatccatatattatttagtaatctattcttatattctccatggctctttgcataataaaaagcaaatagtgggtgtttaatacttattttgaaaatgaaagaaaatgaaatgaaaacaccagaacctggaaaggtagtcattatcccccgagatggccacatttaattcctagagaagataacttgtttagttcttcccacagcacagcttagtcctgtggctccctttctttcaccagagccataatatggggcagccctgtggacagacggatgatcaatcagagttctttgacagccactacttattgagtaggttagtaaaggcacttgtgcagttattattattttatttgttacagttgctccattaggtgggtactgttatgatctccatttcataaatgaggaaatgaaggctggcatagattaagagacttgcccaaatgtcacacaactaatgtatagtggagccaggatccaaatgcaagtatatctgactccagaacccaagctgttggccattgtaatatgttatgttctagagaactgtgaaatagtgctcattaattaacgattacttcaattttgcattttaggagctatatttattggcataagtcacagagaactgttgttataccttggagacacacttttgatgggtctggggaagtaatactaatttgggattgtagaccaggtttctaaattccaattcagttcaagaggtggttcattcagttttatagtatatcctaacttaagagaacacacggatgagatccctggaaattttgccagtctgtgtgttacacagtctcttgaaggtagagacaatctcatatcttcacatttccaagcttataattgtcagtggtcatatcgtaatcttttccaaacccacacatttttttcttgccaaggcctcgagagcactgttgttatggtgtacagtaacaaatgacccagttatattgagttttaaagatgaaccagattcataaagagaaaattaaattatattcattttactttggcagattttcatcagaaaaacataatttaaacaaaaatagtttctagtagttcatttctaaaaacaagatagagtaaatctagaaactctgcagagaaagcattatgtagacattttgtagagggaaataagaaatactttctgtatatacaaacatttagccatctgtttctttatgtatcttttattttccagttttagctctgctccactaaatcaaattcagacccaattctcttaatttagaggggaggaatttgtggcctaggaggcagattctgatgatacttgctggtcctcacagctggcagctcacagggaattttcccttcctggtgggcagctatggctatctcatagagagtagaggcttttaagaatgcaagatcagagcatttcaggaactttaatcagagggcagtaagtgataacactctaaagcctaagtgaatctcataggatagaagcccgataatatatatcaaaacctactgaacctgttatcctttatctccctctcctctctcttacttttccattctccctttcttgctttctccttgtttctttgcatatgtctctatttgagccctttctaagtgtcccccttttttgtactttctttgactcctacttcttttttcagcttcttgcttttctcttcctttctctttttacatattcctttttcctttttctttcttttttttttttccagaattggataatatggtttttttttttaatttaagttttagggtacatgtgcacattgtgcaggttagttacatatgtatacatgtgccatgctggtgcactgcacccactaactcgtcatctagcattaggtatatctcccagtgctatccctcccccctcccccgaccccacaacagtccccagagtgtgatattccccttcctgtgtccatgtgatctcattgttcaattcccacctatgagtgagaatatgtggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccccgaggaatcgccacaccgacttccacaatggttgaactagtttacagtcccaccaacagtgtaaaagggttcctatttctccacatcctctccagcacctgttgtttcctgactttttaatgattgccattctaactggtgtgagatggtatctcattgtggttttgatttgcatttctctgatggccagtgatgatgagcattttttcatgttttttggctgcataaatgtcttcttttgagaagtgtctgttcatatcctttgcccactttttgatggggttgtttttttctttctttctctcctatcttctcttccttttgttccatcccttagttctttcctctattccccatgaattacccatcatatcatattaagcatatatattaaaattaataaatgttaatggtcattgagcagcaagaaggttttattattactgtaaaaggaaaaacatctcccagttaagtaacactgtacatatagcttacaattgaaacttttcttttgagtaacagccctcaccaaaataaggcacctttcctccttccttaaccataattgtgtcttttgttcttcctctctacccttaggtttgatgaataggcacatttttacattttgttttgtgtccattacttcgtgaattttagaaagctaaaattgctacttagtgagacagagcggtagataatttttcagatgtgggtttaggattctagtattctgagtttctggggttcaaacatgccatgtatgcattctattccagaagctctagcagggaatgacagaatatggaatttcctggtggttgaaacccctcatgaaaaaactgcttttagttttagactaaaacatagttgaattgcttctctttgcctgtccaaacagggatttttaatttgggttttaattacttccttgtcctgaataatagttatatgtaatatgaagcccctctcagtttgataactttccagcagttaaccgattaaggtcaacaatattttagaaagtgaatgaacaagtgagcaaatgactagacagagtcccttaaattatttctgttacatgctctatcgtttacgatgagccttgtaatatctaaggttttgcctcttttcagcgacttttttttctttttagcatagtttccaggcactgtcacaaactctttggttctttcatagctaaactcttaatatcttttcttaaaatgttcatttttattaaagtactatataacattatatattaactttgacaaatgttaacgttccttctcaattaggtgaggtgtattcttgagaaggtgccaatttgaattgaatatatttgaatttgatatgtgaactaaactgtaattgtttaaagcttacccatccatcatatgggtgatggagcagctgactgattttacatgtaagtgttttgttttgtttttctagcaatatttaaacattagaaaatgatttcctattctaacaaagagaaattcatatgaatttacttacaggacccccttgtcagttccttagactgcctagaatttaaattggcagatactactttggtataaaatgctttctatggacagtattaatattttaaaatgttttactcctgcagatttccagtagacaggaagtctagctctgtttaccctttggctactaatgagtgctgctgaatgattatttatcatctttaggtagaggtaccacaggtatgagatcagaattgccaagtaaggcaagcatttaattttaaaatttgaaaacaaatccatgcaaaggtgacaactaaagtatagatactcgaaagaattttggacttgagtcagaaaatctcagttgtatccctacccttgtcattaacttagctgagtcaccttgagtaagtcactgcccaactccagattacagtattctctctaaaagcacaatttcaacattgcatattctaaagagagcttggttaaggaaagcttggttgaggaaagctgaatcttgttgtttatcagctatccacaccagcctggcagctctgaggtcagtctccagctgtattttcatctttttgtaatctcttaaatccttgcaggctttcattgctagttcatttccctagaaatttacatttagagacattgaggacttcctacctttgtaatttttctgtgttcatgaatttaatgaaaaattacttagagctggctaaaaaatgcaagaatcaaaagtcttgtttaaatgtctctgtaaaatcagactattcccatcatgactaacaacctttactatttcagagttttgaaatcagtatgtttgaatcttgacatggtgaggcaccattgtcattttatcccattcattgttctagcattttcctactaactccttgttctaaacattcttctttttttttaagcctagaatgagtgaacaaacaacaaggctccatgtcatgagaaaagcactgtagcctgatcttcacttatgttttaggtatttgaaaattacattgatttcaaatagtttgaactgcattgagctaaaacttatcttttattggtctgctaggaaatgaactaaacaaaataacttgcctcaaagtattgagaaattaactgtatagcgacttcagcatgtgtatttttaaaatgaaaaagctagagctaggtacaaaatgtgcttcattaaaggaggtctagcactatattcaaaaggtcaaacaacaacaaatattggtgtggatgtggagaaactggaactcatacattgctgctgggaaagtagaatcgtgcagccattgtgagaaatagttcattggttcctcaaaaagttaaaggtagaattacctttatgatccagcagttccactcctagctatctatccaagagaaatgaaaacatacatccacattaaaacttatacatcaattccctagcagcactatttataatagccaaaaagtgggaacagcccaaatgtccatcaaccaatgaataggtaacaaaatttggtgtatccatacaatgaaatattattaggcaatgaaaagaatgaagtactgatacatgctacaacatggatgaaatctcaaaaatatgctaagtgaaagaagccagacgctaaaggcaatatattgtatgatttcatttatacagaatgtccagaataggcaaatccatagaaacaaagtagattaatggtttccaggagctgggagtggtgccaatatgcagtgactgctattgggtacgtagtttcttttaaggatgatgaaaatgttctaatattgcataatggtgatggttgcacaactgtgaatatactaaaagccattgaattatatactttaaaagggtgaattttgtggtatgtgaattatatctcaataaaagtgttatggattaaaaacattagtgactgtattactataactatttgaaattataaaagtatatttaaattacattttatgccaggactaggggcgggggggaatggggagttagtatttaatgggtgcagagtttcagtttggaaagatgaaaaagttctggagatggaagatagtgatagatacccaacaaatatatttaattttacagaactatatacttaacaatggctaaaatagtaattttatgttatgtatattttaccacagtaaaaaaatccataaccccctaagattatattttatattattctaatgaatgatgtgtcttttactctttttcttcttttaacagtaaaactgaaaatgtgattggccttttgttttttatgcatataattcttctggtctgtattttagaacttctttcctgtgtggcgttgggggatgcgggtggttacacacacacgtctttatcttggctttgaatgagaacttggaagtattttttaaaacttttatttgtcagtaggaaaataaaagaagccaaaccataggaaatttacgtaattaaattataaaatagtgaaatgctgttctcagagtatgaattatcacagatttcctgattttcttggttaatcttggcatcttgaatgggaaaaacatatatacttttatacatatataacatctctgtatcttcctataagcattttcctttgtatagcaggataaaatgagcaccaaaatgtggtgcaaatataaaaacgcagtggatgagcttcaaaatgcaaacaaagggatgggaaaatgaaaaaaagaaaattcagcagtgagaaagtcactgaaaaaggaattaaattctttccaagtctatggaactatgttatgacccaagcagtttgtagagtctgagtttgtaacctctgaggataaatccatgaaaatatttctaagcctggctactatctaggacatttgaagatggatgttatgaataccagtagtgccattaatatagtaggcaatcagaggtatgtttgtttttcttaatcaggaagtggtttcttttaaaagtataaggaacacacactgtgtgtgtgtgtgtgtgtgtgtgtgtgtgtgtgtgtgtattttctattccgttgcaggaagaattatggtttttccacattttacagtggggttttctagagtttggcactatgatatcctacacttgattacaggatccaatcagagttgatgtactcagaaattcattgacatgattaatggtctcctaatcatacttttatttcctagattagccctatttcctgtagtttcacaatttttgagtcatatgttaaattatcctttattgggggcctgaaattcttatgagtatttttagtctataatttgcatgattatttcttttctttgttttttttttaattgaagaaaatgaaattttgatcttcctttgaattctttgagtgctgttctatggtgactggccttcctagtataatcttttttaaaacaatattgtatatatgtgtatgtttgtatacatatatatgtatacatacacacacacatatacacacacatatatatataattttactgccaccagcactagatccagaaatcttcctacaagtttccactagtctagtttttattcttctcaaaagcaaaataaaacattcttagattctacaagtagcagggaaagacatcaggaaatggctgtacaggaaatgtaattgatgattctctctttacaattgaagtggtcacaagattggctagcaaacacaatctattaaatgaaaaaaaaggtgacttctaaaatctttggggaatttgaatacatttgaagcttgttggtacctttgacatcttactgattctttttgaaactcttacctttttcaaacaattgtttgcatttgaaattgggaactttcatatccagtgattgctttaatatttgctttgtttttaacagtgcccttaaagatagccgttttcccccaatgacaagggatgagctgccacggcttttctgctcagtgtctctgctcactaactttgaagatgtctgtgattatttggactgggaggtaagattatagaaaaatttttaaagaaaaatgaaggtaactcttgaggagatgttaaaaattaggcccagaaaataactctttcagcccattctctattgtaatggaggtcgagagtaatatggatgaataaacctcacaactgaacgagatataagtaaatgagttttttaaaggacaaagtgccacgtgttgttataatccccaaactgaatttggttttcatttttctcctactacctcaccaaagcacctcataaaagctgttaataagtaataagaaggactgactggaatttatttctcctcttactttcattctggtgcactctggtataaccgccactaagtaactagttggtcagaggatacatctcagaaacaagaagaaatatttaggataatacaccatttgggggaatcagcttgtgataacaacaaggtattgattaactagagttaaataatgtgaattcattcttggctaccttagtttatacacttaaacactctaacaaataatactaaggttatttctagggtatctctgtgcattgctattgttagagtagcttatattgatcatatttttattcttctttagtacatggggttggctaacattgttagtgaagttcaaaggttctcaccatgatttgctttggtggctgggaggagatgttgagtgtaggtctattgggtctatgaaattttacacacaagcatgcccatattactgaatgcctgttttattccaggcaatgtgctccatgtataaaagtggtaagatttggttcccaccatgaagcatgtcataatttagtggcgagtaaatgtgtatagaaagtatgaagaaataagtgctatgagaatgaaacaatgggaactcagtgataaacataacattctctctcacacatacactcataaatggcattattgtatccttatgacagattttaattcttctgctgttttagaaggaccatcccccatagtaactgaactattctgccttggagacagatcactgtcttcacagtttattagacttgaatttaattttggctttgccctgattccttgtgagactttgaacaatttacttactccactgcaattcagttttccaatatacagaataagacatttataaggttcttcatttgaaaaaaaactctatgatataaattattgttgttataccagagctatttaaaaagttttagggggtggggtgaaaaaaaacttttctacagagagtacaatgctagagtcccctctgggttttgtgctaagattttctggagcattatcagaatatgaacacatcttaggatttttgcaaaggaagaaataaaataaatttatactgttgttcctaccaaagttggaatgtagaaaaccttttgtaaacttgaaatttctgatttattatttgctataagtttgttgttcttacttgatttttcttaaagaaaagtctacaaatattatggaaatattccttagtactttatttttaaacagccccaaatcatgttccctacttattaacatatattatagtctgggtggttcttttactgttttaaggctgctgtttcctcttccgcagccagatttacttttgctttctggattgcagggtgttgtgtatgtagtagtggggatgggagtgattatatgggaaaagcctgagatccaagggggatgaccaagctacaagaacacttctactcttgcagctactgagttggaagtacagttctggcatgtgtgtttctgtgtgtgtgcatgtgtgtgtgtcacaaacatgaacatactagtattacataaatgtgtgtgcatgtgttttgggggaaggaaaaaggggagaatacaacagctgttacataggcatggttaagcaccgagtacatcatcatcatctttagcccagttaaagcactatctacagctaaaattaaccttgatattattggactattatgtccaaaagatacatcagctttctgtttgttaggagagtgggatgtaaagcccttaagaagtagtactgtgtactccactatatactctttcaaggcatatttatcctctttggtcaccatctgccagcctgaatttccagaagattctatattgttcctacttggtattgtgtatttaatatattttagggggcttaaatattaatttctattaagtattagttccctattgaagcaaaaaatacactttttttttttttcgagacagagtctcgctcagtcgcccaggctggactgcagtggcgtgatctcagtacactgcaagctccgcctcctgggttcacgccattctcctgcctcagcctcctgagtagctgggactacaggcgcccaccactatgactggctaattttttgtatttttagtagagatggggtttcaccgtgttatccaggatggtctcgatctcctgacctcgtgatccacccacctcggcctcccaaagtgctgggattacaggcgtgagccaccgtgcctggcccccattttttttttttacttttaatatacaagtatttgaaagtgaattagttactgttagaatggctatgctaagaggaaaagcccatccttttcagttagttcatcattgtttcaggtatttggcagaagagaaatttgtatacaacgaataagggtggaaattatatttttaagtacaagaatgtgatttggtcttaaaaaaatatgtaccttactcagtgattgaaaatggagtaatagtattgtgggaatgatattctaagggttatccttaatgattctgaaaaagcattactaaacacagaatgccaaaatggaattaaaggcattaaaaaattatacgttgacacaatttcacttctaggtatatacccaaaagaattgaagtgttgaaacaaaaacttgtgcatgaatgttcataacagcactgttcacaatagccagaaggtggaaacatcccaaatgtttatcaacagatgaatggataaatagaatatgttatattcatacaattgaacattactcagccataaaaagaagtgaaatacatgctacaacatgaatgaaccatgaatacattatgctaagtgaaagaagtgaaacacagaaagccacattccgtatgactccatttatgtgagatatccagaatgagcaaatccatagagatagaaagcagattaatagttgctaggggctagggggaggggtaaatgggaagtgactacttaatggtacagggttgccatttggagtggtgagaaagttctggaaccagatagtggtggtggttgtacaatattgtgaatgtatttaataccactgaattgtacactttaaaattgttaaaatggcaaattttatgtgtattttactacaataaaaatggaaaataaactttatacatatattctgttcataatagcaattttaacttatcaaagaagaaaattttttaaattaaaaacatataatgagagaaatgtgagtcatttataattacaccattctgagaataactactgttaacattttggaatatttctttccattatcttttatatattatactaagactttttaaaattttttttccattctttatctgtctttgtatcaataaatctgaatatttggttacataacagatcatattgaatatgcaatcactatttaaaagattgtggggaagtctttatggtttatctttgtatataagtaaattatattttgaatttcctttttgagaagtcagtctatattatgaaagtatatgcttcacgagaattttcacactaataggtacaacttttcttccaagaaaaaatatcctattcaccataagtatgcaattttaacctgaaatgtgaagtcctgtgtatgtttatgccacaggggaaaacaaggagattattacagaattttaatacagaatgttaaagttgaagatagataatgagcatgttttatacaaacagaagcttctaacgtagcacttttctggtggaagtacagtttgagaattgacccccactggttaagtgtgttactgcagtggaattcctaattaaagggatgaaaatgcccagattaaagcaggaagagggcaaagtctagaagtcccaaagcatagaggtagatatcttcgctaccaagacagatatccctgtggtcatgaggatgaggaacgtgaccacgatcagtggtaatagccacccagttttcagatgatcaggaaacaaatgaattgccacgcgtctggctaccatcttactgtctttttcatgcaaggtttttaactcggtctatttgggaactttcttctgataacatgtctctaattttataatggaagttagtaggaaagtaggatttactttagaccttgttttaggagctagagtgcttctgtttgataatgtgagggatgtttgacaaatggttttacaaatggctgtaactaatttcaagtcaatattgaattgacagactaatcaataatgcttccatatgttctatttcctcagaatagtaattataacatttaaaataagtgtttatgggtagcctctgaaggaatctgggcagtcattaaaaataacagccatccacaaaaggcagtaaggacaaattagagcagtggccccacccttccaagaataactgatcattgcccacatcatgatgtacttattgtcctagtaggtatgagaaggatgaagagtgaataatttgaggaaaaatttcattagctgataaattggaatgtctacctgcaaggctaaaatggttgttaaatgaggaaaattgctcccctagataaatctgacatgatatgctttgtgtttgaacacggaaactcatcaccattgttctgtgttcttcagttgacatcattttcttaattctgaatgacagggtgattgacagacatggtgctttgtaaagaaagaaaaactcatgcagcatgttggagcctgccaaaatgacatagcctggaacttgtagagttaaactgtttgggagccatgtttcctttttaaaaatctgaaaggatataaaaccagacattacaatggactggagcttgacttgaggggtgattctatgtgtgtcacctcataggtgctcattttcaggatgatataaatgaataaactttttgtttgtagaagaattcgtatagcaagtatgttaccagtgattttgtggaagctaatgtagcaatttgctgacagaagtcaaaatattttctaaattgtaatcaagcgtcttttacttctgtgctttagagacaagatcacttgaaggcatgaagtaaaaatattctctgtattctaaagtaactccttagatcagatttcaaaagattaatgacattttcacaaaccattagtcactttctcctatatctggctacctggatcactggtatctcactttttctatacagctgtcacctgggcaatacattgtggtcccaagacagactgttccattggagcacacaatacgtacatggaatcaacccatgctgggtggggctggccagcacagttattgtatgatgccaaaaatctgtccctggactataaagctatacctcaggcccctgatctcactctgtccctaaagtaccaaagcatctgtcattgtatttgagcctcgttggactcctggtactcagaaagctgtgtttcactttaaaagcaacctccaaggcacacctcttgagtgatcacagctcaattctgacgtgttcagttgcagttaataatagggtgcttttgtaacaaccttcgtgagagtaaacagatgagatgaataaattggctactgtcattatctcccacatattttagaagttaatgttcttttcaccctcactccccccttaaaggtttacattttttagctcctcttaatgtgccattgaaaacagagttcccattcatacacagatggtaagcatgactcatgaagtcacccagcgaaatgacttctggttgtatatgttatgtttcccctcttggttagtttttcccaactatgatatacatcatgttttttctctcttctaacttaaaaaatatgagcttcatatatccaggaaaatgcttttcacagtacatattttcccagggacgttgagtttttttataagatgtcactatcattaagattagtcctttcttgatgctctactttaaatgttttttttttttttaagtgccgtggagtgttgggaaaggaaggcttcaggcttcctggccatctagaaagagtttgctgtgcatcaacaagtcaatgtataagaagcctagtggggaagcaagctgtacaaagtaaagtaacttcttagaaggtgatttaatgcatacaaatttccattagctgttggttctcttagcaaaatgcgctgctgattagtcccttctcaggccgcctcaagttgtctccagttttactcgcagcatgtttattggttggaggaagttagcctgctgcttccccagaattccataaactccctgccccttccctagtacttttgttatagctattatttcatgtatgatttgcctgtgtgtgtgtgtgtgtgtgtgtccccagcatttaattaaaagaatgctgaattttgggaataaggagacctgggttctgttcctgactgccactgcccagctctgtgagctttctgggcctcagtttcttcaggaacctgaagaagttggactaagtgatacctaagatctctttggactctgacagaatatgattctgtgacatactcctttttaaaagatggcttctgtttcattgtccagagaatgaatcaccactagccatttagaagtcttaagaagaggtccctaactttcaaagtggccattgccaagttaaatgtaggcaacaaacgtgaaaaacagtccagtttttaagttgtaccttctagatttcctgttcacaaaaagaattcccttgaggaagaaaaatgctctaagccattaatgtctccatttaattactgtatcatcctgttttaagtcaacattatatatttaagtctaaattaggcaaatacattagggagcgattcactttatgaatacgtattttgctttgtagaagaactcactatagaatgttattgttttcctcttgactttaagattaattcatttatgtaaactcaacccacatgtaactttttaggaacaaatttcttttgtagactaagttaaactgtattgagtcagatactcaatgtacagttctaatgaatacaattttatttttcttaatttcttattaggcaaacagcattatttcatattaggcatgtttgctaggaggtgatttcttccccccgcccaccctgtccccactagcctttggaaagtaaactaagtcacatctctaggttttgagaaaattttataactttagttttcttgtctgtaaattcactcccttattcccttttttaagaaatggaaggaatgcatttttctaactttgatagaaagcacgctttttatttaaaggtcacctgtgctgcctgaacatttcttgggaagctttaggatgttaagtttttatgggatgctcattataattaatcattacagagaattgggggttttttccccttaattgcactctgagctgtcacttgttctctgcaaaatcttagagtaagatcaatttccttcattgcaaaagatatataaacatgtttggcttcagagtttttcaaagcacctcttcattagccatactttatttaaaattttactaaaatttcatggtgactattagagagatcaggtattttaaagctgtgtgtcagctattaaaataaatgttaccagatcgttgttcagtggcttttgtgaaataagttggcaggcttttgttcctgatagacaagtagtctgtctcctacataaatcaaaattggccctaattagtcctttggtaagctctgtaaaagccaagaattggttcatggagactgaactaatatctaagccaaaggtgactaatctgcagggattttaaagaagagcaacacatatgtattttggtcaaggggacctttttcataaagtaacaactgagaaaaaaagaaaaacttcagctgagacagatgatgaagcagaggttttatagtagagtacgttaaaaggttagtcatgctcaggtgatgactttgtaatcaattatcctttttgattcatgtttctggtattctgcttctaaacgcatctcaaaggatatttgaaaataaagacaggtataggaactggtcagataatgtataaaaacagcctaaaatatagtctgtggtggtatctcagttggttcaggagaaaaataatttttacgtcactaagataagagttatctctagtcggatggtactaggattacaggccatctttattttctcctttatgctttcctaaaaggatgctttatttgtttgtttgtttgtttgttttttagagacagagtcttgctctgttgtcgaggctggtctcagactcctggcttcaagtgatcctcctgcctcagcctcccaagtagctgggacaacaggctcgagccactctgcctggctctaaagggaatttttttgtaagacatatgtcctccttttataaaccagaaaaaaagatgcatgtttacagtttctaaggtttacaagagtaaataatactcagcaaaaacaaaagctgaatcgcagcaacattgttataaaaatttacaatttggccagattatgaagggatcatgttagatagatatgtaccttcagaactccagaattgcttttcaaattggtggtcaggttgaagtgatgcagagtaacaactgtgaggatttgatgggcagatcgagataatatgtcatctaaatttttttttttggtagtatcagatttggggaaagtggttcattaggatctgtacaaatccttatcagcttctatgattaaattcttaacttttctagctcaaagaattatccaagagaaacttggagtaggcctaagttcgaagtatttttctcttttatgttgaatttgctttcactaggaaaaggaagagtttctgttttcaaaaggctaagctggagtagtagggcagaaggaactgtggggcaataagttcaagagtggaccatgctgcaccatgagttttgtgctgttaggagatatagcacatagttttttcctcctaagaatgtcagaaacaccagactctgggtcagacccatggactgtccaatacagtgtttgtttctggctgtggtacccagggttgttttgtgagagagcatgcattccttctgtgataccagcctctaaaggttagggggtgtgccaaacatcctgagctcctctcattaggaacagtgtcctttcattcacttcaattggactggcatattgagcgtggcaggtcagtcttatgtgaatggccagtaactggatgctttgttaattgcaaagcatattttgccaaatgatttcatccaaaaagacatgtcaaacaactttcgattctttgacctcctgatatttcttatgctattcagatgaactcactgaaaatgagtagagtaagccatggccatattattacagggaaacccagcatttggttctgaaaatggggaagaatgggactgaccatggtatttgctaaaacaggatgccacccaaggtagtagagtgattctgttggccaggatgtaattgggaagatttagctttgagggtcaggactatggagataattgtggacccaaactgtcagaagtttacatggaggctactcaacttagccagagcacattttatactcatttatgcttttagccagatgactctttttcatgttttagcatattcagattgttggcttgctgacaaggctcacaagtaaaagtgagactcttttgtagtgctgcttgtggatcacaaggctaacacttgccttattagacagactagggtatattaagctttgactgtgcaattacaaggaatataatatgggagaaggtacttttaaaaaatgctcttgtgttgagggtcactgcattagaggataatagttttaaatgaagccacatttctaacacgggactagataacaaggataaatgaaatctgcagacagtctcaaagcttaattttagccattatttataatctcttctcctaccaaaccttttactgtgtagcaaaattgattaatttgtgtgtacctcttctttctgtgaccacgtgctatctgatagaggagtgaaaaaatagagaaatggacaagagacgaaagaggatggggctgaggccaggtggagctggggatgcataatccctaaactggataatcaaccccagaataatcaagatatattttagggtcttaacattaatcttgatatttaatcattctgaacaatgttaaaaacaaaagattgtataatagcattaataaaaatcacttgctatggaatggttcagaataaatatggctttctttttagcatgaaatatgaatccgttgaactggtcttaatgttctatcagcacacacagatacagctctgcttaattccatatcctcttatctataagtcctacatttaatttactaccattggggttgatttttagctttgcttagcaaaagtagtcttgattaaaagaatattatcgcaactgatggacctcgaaagcatttttttcatagaccatctagtaattttgaaaatgacctgcagacccataaggctagatttgcaagtttccagtttgtacccacctggctgtacttcaaacagtggcaggattagttaggggtatgtttagtgacatagtattcccacatgctgccccctcatccatacgtagaaagttaccgtggtagtgttttaaagatctgcttcggggaatcccagttccctggttcgctgatcttttatctagtttataattgcaactatagcctttgtctcttgggatgttgctgggccagaggattctccaatatgtataagggaagattcaattatgcatgagggttacattttggagttgtagctgtgacagatgcctccctgaaacaatatggaattagttttggtgctcatttcattgcaaagccagtgatttccacaggttggccagaattggtcattctccacagcaggccatgttctccttctcctgttttgattgttcagtatgactatttagtggcttgtggttctaggagtaaagaaaatgctgttgctcaagaggtaacagaaagaaagctactatgattttgttaagaacattattaccattctcctaattctactagctgaaaaaaatgagtcactctggtttgggctttgtagctttgtgggagtatttttgacctatgaaaaaagttcataaaaagaattcactttaaaaccactatacttacagttcaatttacaggggctttcaattgttcagagtcataggaacccagaaaagaattaaaagttgtaaatgtggtactaaatcaaaattggagaatttggggtttttttcttatcaaatttgatggtaggaccttctcaaaatgcagagtaaataaagcagtcttattcgtgagtaatttttgttttggccaatatgtcctttgtatccatacacacacagctttattgtgataccattcacataccatacaatcagtcttaacttcttttaattattaaattactagacattaaaaatctgatatttttgttcaagaacacaggatgtactcctataaagaaaggacttaagtgtctaaattaaccccatttgcctaaatcacttttaaaaatcttagtatgtagccacagtttgtcagaactagaatgcttattagaggttatctagttcaattagaataaaaattacctggggagctgttctttttccaaaacgtatttgttgaaattctgataaactttgcagccccgctccccaccccttgccagttaaatatcattaattttgtctgacactctcatctcacagatagggagacattcttcctatcacaattttgactagacaccttaataaacaccaaaattcttttcaattttaacatgacgggtttttgataaatagagttgaagattcaaaattcacttcagtggatgatggagtataaattacttatgctgtgtatcttttaaaaaacaaattatgaggaatctgatattgtcaaaggaaaaaaaaattcaaagctactgatcaggaagtcagtatacaggaaattttgcaaatttgtcattgtctcatcaggcactggagagattagtagatgtcctttatcctggaaatgcctgatagctaagcgctcatatttcttctcagctatatacgtagttatttcccacacagtatgggaggcaagtattgtgttagtttttaaacagctaccctggtcgcatttttagcagaaagagattcgtaagagtactgatattaaatagatagaagaaatagccagagatatgctttaataaaaataaaaaaccataaattcctcagaagatctgacaggctctaatggatagatgtgtgaagacctggggaaagatgaaatggattttcccagaggactttttattcctgaaaaaattggaaaatttgagactgggggtagaagaagcaaaagaagttttcattgaccccctttcctcttctagacctttacatccatacacatggaaagtataaaggtttatgactttactcacctgctctgaaaagaagcctccatcttgggtaataatgtttacctggtcttacatctccattccagtaccttgcacaacctgaccctccacttgggaaccattgatctgaggcaaccacagatccaagagaacagaatggtgtcattatgcttttgaaatttcgtttttattatcaatgttcacaaagaagttaagaacttttaattttgatctttagctctgtatactattctatgtgagatatgaggggaaaggacagatttctttcaatcatatgctaatcaaaggaaaagcacattattaaaaaaaaattagcaagaaattgctcacagttacttagaagactacctttttaagggcatcaccacaagcttgttttacattaaaaagttacagtggtctctgggctagtatataaagagactgcaataatgcactacagtgaagtgatttgaaatctttattcttaaatttagtagagctgtgtgaagacaatggtgtagatggacagtgaaggtctgctactaccccactctaagtcataatgcatttttaaagaaatgctgtctacactgggtgatgatgtaggatctggttgttttcattattaattttcaatcttacctgactgtgtttgcttgcctacgtataatttaatgttttaaacggagtagacagtttgggaggggatcagcaccaaaaattttggaacttaatcagaagtggtgagtgtacctgcaaaacaggatggttgtttgctatctctttgaagtcagtcacctttgtctctagttctttattggcatgagctacaatttgggagtggggcaggatttttgccatcaaccgtcttattctacagacagcttcagaatagttgttccagttttccaaacatagtatcatagcctagtgcatgttgggcacatgcaaatcaatattttccctctccgtggccatcataatggccttcaaatccaaagtcaaagctttggaaagagaaaacttatacgtccttctaaaaacaaagggaaaggaagaactgcattctcttgaaagttaaattataaccttttctttctgattctatgaagaagactgtactaataaaactgccaatttctttcaggtgggtgtacatggcattagaatagaattcatcaatgaaaaaggatcaaaacgcaccgccacctacctaccggaggttgcaaaggagcaaggtcattgttgtactttatttcatatgatctggtgaagaatttaaacaaatatacaaactgaaatgcgttatctgaccttgcagttatgtctaataattgaagtgtcaaattataagaagtgactcttccatcactgccactgcaatgtctgtatcaagtcggtgaagtactcacagaagttgaatccctgcattgaagtttgatggcataaacccataagtgtatattttttaaaaagcagaatttatattagttggttttcattttaggcaacaatttgctaccgatttgaaatgcatttttcccatattccattgtggcataaacaagccttttgtttgacaatcagccacatagttctttgtcattttaagtatcaaatgtttcattcttaggtggttgccattactcatcctgctgatactaagattctaggtttcccactaagatcagaggattgcgaaaacatgaagtgttagtgttttatatgcttggtctacacttcctaatcagaattttcctgtttcacacatagagcatagacctgtatgaaccaacattgtaacacaaagtaacttttcactctgtagtattttatcctttcttagcaactactaaattctggtttcatgttggtcgaaatgaatcttttatcttggggagcttttcttctcatcagaaagcatttgtaatttggttttcccgtgtttgtcttataaatgtgagatacataatagcaaaattaatgccattaaatccccagatcagaaagtcttcaaggcagttacttgaagatttatttgggttgctttagaaaatgtcttaatctcctagtatcattaactttgtaaagcatacataaaagatagagggcctcagatactagtataccatccatgtcagaactaatcaaaatacccttgaatactgcacacaaacttgaatgattacagaattacagaagataccataaggaacaacaattactgtgaggtggtgtgggagtcctaaatattgacttggcaaaatggcatataggcttttcactcccttttaaagatgtcactgttagaggaaagtacaacagatatggtttgttacagtcatgactgagcaatttctgccagccccttagaccccttgacttcgaatgcgaagataaaggagccagtgttgtttggcattgtggatagctagaatttaaggagtgtggtgatgaccctgcttttgtaaaggatgaaatcttagcttttctgtgtgattgtttttaggaccaaaagatttgatggcatttggtgacagtgatagctgacctctacaaagtcattttgtatttaatgaaaggtgtttgttacatgtgcttgactgatattttatctggtcatctctctacaggatgggaccatatacagaccatagactccttattgaggaaaggaggatacaaagctccgattactaatgaattcaggaaaaccataaaactgaccaggtacagaagacattttctagcacaaggctaacctgtacattttgatgtgtatgcctataaccctttgatttctttggtctctctaactacacttcttttttctgaaacagagtggaaatgaatggcagggtcatactgagggtggatacaatggaactctgcttcgtagtaaagcctgtgtgatgtatgagcctatctttcccatctttagctctgtgtgattactctggcttttgtacgagcaagcccttggagattttagactactttattggagaaagtacttgaattagcaattggctagcttttgacattactgagcagaaccccaggattctgataaacagtcctcaaattcgaatttaatctcagaattttggcagtgatagaagtctaccaagaaaacttgttagcttgctgaaaaacacaattgagctaaactcaaatgctaaataaatttcagcatgaaaaaatagggatgcttatttaaaaaggaaaataccgtacattttaggaaaatgggctgctggttccatttatttcaattccataaaactacattgaatgcttatagtctaaaaatggcctattctcagctctgaggagttacaaattcagaaatacctccatctctgctctccctgagttcacagtggaggagaatagaaggggcatggacaaaattattaatctaaggcagaatatgatggataatatgagatccattcccataaagtagggaaagaggaattctaagagggtgggagggggataacagatagtttcaaagaggtcagctgggggctgggtttgaagaatggatagaatatttgacaggtaaaaagggatttttttttgacaggaggaaagtgattcccttaaggaagaccttgtgagtcaagggtggtgaagtacaaagcaagttctgagaatatgaaatagtctgattgggctggtcttttagtgtaatagagaagctgatcattagaggaaaatatggcccagaaggtaggttgggcagaccattgagggtcctgagttccagagtaattagtttggacctggttctataggcaattggtagctattgaaggattttaatcagatgggcttggggaggtataagaatggaattggaaacaggaaaatgagccaggaagcgttggtattatctaagaatctgtggcagcagtccaaaagaggtgcaacaggggccttaactagagctgtggcagtgagatgggaagaaaggttgggatcgatatgaaaataatgtggaagaaatgaaaggactgggtcatcatttagaaataaagaagaaagtcaaggcgttaatctagataaaagggaccaaggtaatccctttaatcaaagtagggaccacaagaggagtgtgttaagtttatgcatcgattttggatttgaggtgcttcttaggatatctatatagaaatatctagtaggtcaatgaaaatgtatgagctcatggctagatatgattgaaattgtaaggatagggttcactgtggggggacagtatagagtcaaaataactgaatacagaaacataacaaaattctacaaggcagggataggagcattcagagacaaggagcaatctgagaggcaggggagaaccaggggcatgtggaggtatagaatccttagcaccagagagcttaagggcatgatgggcaaatggaaagatcaagctgagtcaggggaagccttctgatggctatttccatggaagggtggcagcagaagccaaggagcactgagctgagtagtagtgtgagatggggattgaaggcagaaaatacacacaactatttgagaaatgtggcaatgaaaagaaagccagacatggggaaaagtgagagttcaggataccagaattaagaaaagttgtttttgttgttgttacttaatggtaagacctaagtagatgtgtggacagagaaaggaacagtaaaagagggagaggtggaagatttctgaagaaaaataatcaactgaatcgaatgagatgcatactcctgttagaaaactggggctgaggggacaataaaatttttaaaagaacaatttaaacaaggagtagtagagtgcaaagagcactggactcagacttttgatttccaagttctgatcttagctttgctacttactatctctgtgaccttgggcagtcactgcttctctctgggaccccgtttcctgatctataaaattatctttaaggtccttcctagcagtgacaatggcatgtcacctacttctcaatgttaacttttctcttccctgactttctttcaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccgag

SEQ ID NO: 1196 - DNA, 124015 bp, mus musculus
agcggcgcgcgcgcgccccgccagcctctggcgcgcccccggcggcctgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctagtgagtaccgtgccctccgccgccctctcccttgcgctcgggatggggctcagagttgaggcaaagtgcgagtccgcctcccggccggcggatgcccctgccctctcgctgcccgggtccccggagctactcaactgaactaagggcaccctgcgctttttgccctccgaggcaggcaccccacacttggagcagggtgctgctgcaaggaatggccccgtggctcctagaggtgttagctttctctttgcgatgacttcgaggagttttgactcctttacttgtctccttcaccacccccaccacccctcaccctgccccggttttggagatctgggttactcaaggtgttgacctctcctcactttggtttccattaccccaagtgaaagccccgccagtattcccgccccgcgtatcttgcacatggagaactactatcccattgcaggatgaaaaatagcaactatccaacttctgttagtgatggaacttagctctggagcttgtgaggttacccatcttctcctctgggttttcttgtgccctgggaaggggggaggtttcttaaaacacatttttcccttactacttatttttatccaaatacacccattaaaatgtgtttctcgtgtagcgagcgcactgccggcttcctcacatttgaagagtgcgaccttttttttttttttttccattccaccgtctggataatagctcattcaaagagaactgtccccacagagccacggtcagtttgtacattaagcgtgcattcgcttttgtgtcgatttcactttttaagaaatccatgttatacttgatgatttgagaacagttaaatagtaaatgtgtaggaattgttatggtttcctttggttttgtatcttaaattattttacccttcaagtgtgtggttgaaaaattttaaaatagcactgttacagctaaaagccaggttaattctaatccctgtccatttggatgtgtgggaggtggggcatatggttttttttttttaatgtgtaaactgaatgtaaactgactttttgcgttaaatgctagacagaatgtaaagaccaagagagggcagaatgagaaaaagtgcaattgcttttatttgagtacttagcatcaacaagaaaaataatacagaaaaaatttcagtgaaactcgtactgaaaggcatcagccccttttccagctaagacaagtgccccttgtcccccatatcataaatacctgaattgatgttcttttaaaactgctccttttcattttgtgagattagaggattggactactgttgtataagtataaacatttctgcctagactaaaatattaaattaatatgtaaagtggaaattacaataaagtgtcctggaaattgtgcatttgtactgtttgttttctttggctttcattctttaaatgtctttaattttgtatgactcttctgtggtctgtgcattttcttttagacttggttaatctttgggcattggtttatgagaagtgcatgaaagagcatccaggagaacacttcgtcaaataaatatctttataaatttcatagtgttaattctagaagcttaaatcctaagtccacacttttatttagccaattcatttttttggttaagaagtaaaattcattttgaaaagactgccatgtaaaataaatctatgaaatatttattagcttgagtcacttatttgtgacttttatgccttctcttggatgtctgtgatgtattaaagctagtcctgggatgatacttaggttggctctgcaaagtcatgggactgcaaaaattcactcctgtttagttcttgagctgttaacatgagtttggcaaaggctgctttagtattcacgctccattgctccaaagcatatgagaacacactttcaggaggtgctattttcacacattttacagtgagtttgggttaactcaatgactataacaagaattttaaaaggaaagtgagcttgaccagttcatacagaaaatgcttttgaaaatatcattttaacagtagccactttgcacacgtatttagatattattctattcaaacaccccagcccctggatttctttttcatggaattaagcagatgataggacacactttgaccactgtggatatgttgaaacggtggtggaagaataataactattatcatctagcagaccttgaatgtgtcatgtattctataaaacaactaatgtagagtagacactaaacatgaccaagtggagaatgaaagttcacttaagtggaaaatggactgtcttatttccatttatcttcaactcatttttgaggtgtactgtggaaaattcaggaaaacttcctgattatgggagggacataactaagcatttcaacagtgccttagtaactaccacacatttgtctttctgttttacatatttaacagcattgtgtacttattagtgttgctttatcctaagtgccataagacataaacagacatattgggatttttttttctcatagttattatcatgtcatgagcagtgtgtttcaggtcatgtctctgcccaccagatgttgtgcttttgacagttttaacttctcatacgtaaacgcacactcttttcatcctttcccaggacttttctctcagaatgtctgtaactggtgaaatcctcgttttatgggtttagaagctgtagatccatcagttagttatccttccactcagtattgaggggatgtcaatatatgaacaagctgtatggatacaaattcttcactgttgcccccatgttttgattacctacccaattgcagaaagcattgtacaggcaagtttgtgcacagaaatctggttaaagacatgaggaaaacttaactttactgcattttgatattcaaaatcagcactcttggatttatgtagggagcccagatagctattttataggaacctgtttgctactataaagggatccactgtgccaggtgttgagctagttagactccagagcagtcattcttaactttggctgcacattggaatcactgggaagttattaaaaatatggatgcctgagccccaactccagagattctaatttaattggacttgaatggggtcttggatggggcctgggaatcaggattagtaaaagctcaccaggtgagtttaatgtgcagccaaggtggcgaaccactggttatagtctactgaatctttctcttgagatttggataatttgggctagggtagtgccttggaatctgaattttatgagcaccctaaatttcagtaaacaaccgatttgagaaactcttgcattgtggtctgcagaagacatcacctgggaaatcattacaaatataggctctcaggccccgcctcagacctgctgaattagagtctgcagtttaacaagctcctcaggtgattcttacgcacattaaagtttgagaaggactggttctcatactttggagtacatcataatctatagtgcttgttaaaacacaaattgttgggccccattcccggagtttctgattcagttggtgtggggtgggactgtgaatttgcatttctaacaagttccctggtgatgctgatgctacagttcccagggccacacgttgagaacctctggagagagaattgaggacctgaataagtacttgagcgactgtaatggaatggcaattttcaaggccagttttcagtataaaacttcctgcttctgtgtcactatgctttagcatgttcattctaacctagcacccaggagattgagtgctgccgagagtataagagtctgaggttcttgggatggttttagttgaggggtgagggtgactcttggaaacctgtggtatgattttaggtcctttttcagaaattgttaaatgtaagggatacattttaggagttaaaagcattacaaatatgataccttaaggtgaattatattgattttaataagtaaagccccctttgttcccataaaatgctcttatgattctttcactaaagtattgtgaaaagattttaaaagcttttacttatgcctatggttgctggatttcattttaagactttccctctgtaacaaaaatatgaaaggattctgctaaggcactgggattgttcagtcttatatctttaatgctgctgcgtgtcacgttacttgaactttttattttaatcatcctaccacctttgaagttaacgtaatactacattttgtatagaccatagcacatagaagattctttattattaaagtacatcagtaagtgtggttttaaattgcaattaataaaatgtattttaaaaaaatccactcccgcatatgcagattttgagactctgaagaggtgttttaacagttaactctttctcgtcttgccaccgtagtcaagttgctgtttttcagtgtgcttgggaggaattgggttgtgttggggagtaggcattttgtttcaacagaactgtggcaatcctattgcattatcaaaaagatgatttgatagtgctgctcaggttaaaatgatattaaatttgtattttaaatataagccattatatttctgttatatgttttctgatgaagattgaccagaatagccagaagatgtatctgtctatcgcagatgatgccatgaggccatgacagatttccttatccacactaacataacggtactaacttgcattctctggtcataatgtatagtttttcttataaaagcaaaacactgtctgaacaattgagtcattttgaaggtataatatggttgtttttttttaacaatgttgattcccattggaagacaatctgatgtcgtatcttatggatagaaaagaaggcaggcatgtccccagttgtcagttgttctgtaaaagccatcagtgactgagctagaaggatggagaaatataaatcacaaaattgtttttatatccatgcataaaggtgtatgtgggacaaggtatatttagttaaaaagaaaatgcttattttgctttctcccccatatggccaaagggagtgataatttagcccataatttttcttgcttatgaattatgtttgtgctatactcaggtttcagttagcgggtggcagccaagtaggaatctctgctgaaatctctcagtccaatgggaagaaagaccactactgaaaaagtaaaaaatggtctgttaacccatgcatgagttgtttttctaagtatgtatttctcaggcacatgctaacatgtgtgttgttgtctttttaaaaactgtatgctttttgaaaccaaatttgtgttataaatactaaaaccttagctgtagtggattatatttttgaagtgaattgcatttcctatttatagacagttttactttttgagaatttatgtgtgaaacactaaaacttgtgtaatgagattagtcagttcccaagttttcctgatttcaataggcattattatgtactctcgatgtcacacatgcttggctcttataaagcagcacaatgaccagggcttttacatttaaattttgttaaatagtctctttttcaaacttgtgtaataatgtctctttttgatactgttctgaatcaattaagctaagtaagtgaggaccagcagtaaaacccagcatctgccaagaatggaccctcaatgtgtaagctgtctttccacaatcagtaattgggcagttgctcacaggacactggagacagtgtgggaaaccagtggttgtgtaggtggaaagagtagattcccaacagtaagcttatttagagtttagcttctgtagttagtgttgctaagagcaaaaatgacccacagtttatgtagtataaagaaaataacccaaaggaagaagtacagtgtaatagtatagttggttgggtggagcatgttttatgttcagtccaactataagtggcatcttttgtatcaagtgtgggtgtattttctacagctcttaatgtttcagacattgaaacttgctcaaagttaaaaatgttagtgttgaatagctgagtggaaattatatgtcattggaaaaaaaaaccctgtttttgtaaaaaatatacattatcctgagtttcatggttggaaaccagaaaaatagaaggaatagtcctatcctcacagagcttacagtcctgttcaagatatgatactattatcaaagttgcttgaaatacttacaaagcaatatatacatgattgtagattaataaaatacacataaaatgcatacacatggaaatgacatggaataaaggagtggtcagggagaaggctatagggagggaataactggaaccaagttttgaaatggaggaggtacagaaattattggtagagtctgtttgaccagtagatcttgaagtcttacttggttgttcttaaacccgttgctgtcaccaccacaccccttgccacagtacttggggattcccagcagctgtcttcagtcagcaacttgcactctcagcattcttcatatcactccccttgctctggtctctaagatcataaaacttcaaggaaattaaaagtggcctttgtgttgagaatcctctggggaggctggataagagatcttgtatctgcttatagtttcttgtattaggaagagaacaggatttgcagaagagtcctctagagtatcagatgaattgggagaagagtctcaagataggggagactaactaggcttaaggttatgagggcagtaggaaaactggcattggaaagtgggaaagccaccccaggggcagagtttgtgaatataggaatgttgcaaaattgagaattggaagaagttatcagcatatgcaagggttcatactctagggccaggttttgtgtaggagtggaaagattgtagctcacctgtttttggcttccatcattgcctcttcttttcttggctctgtgcctagctattcttgtgctcagaaaaagtttgttaaacagctctgttgaaatggctatgaaatttgatcacaggcataagaactctcctcccctttccctcttcacctattcccagctgtatctaatttgggagaaaggatgagaggacacatcggtttatagaatttgtatcaaatataaagatagctggaatagcttttggatgaggacctgtgattaggtgactacatgtgcatggagaggcactgcaggaaaaaaaaaaacaaattctggttgcttggcagaagtaaaagaagagaggctttgaacatgattcagagttcataagcctggggaaccatgaggatggtggtgccattaaaaaacatggggggaatatgggaagaaacaaatggttgggcaggtgaaatcagatttcttactatgtgtagttccaagtgttggcagttatcaaatgttatttctttttgaattaccagaaccacagagcagcaacagagctattgtgatgttttagttggccccttgggatcactcccccactttgtgactttgaatggctcagataagtagatatcagtgatagttttcagctttgtactgctagtaaaaatacctggcagaattttgggtttctttaatgtaggtttttacattttcttagtcttcaggcttatcaatttgtaaagcaggcagtgatccttttatttccttatgtgtatatcatagtacagccttgagcaagataaagcctcgtggcaggccatctcaggaattcataatttcagaactaaagggaaatttttgaaggactagaagtgcctttggtacaagattctaggttgtgtgtcctaaagcttagaaagtaaaatagattgaatcaagctggatctgttttgtggctttgctcaatgatgaaggatggatgttatgaactgatgggatcagccatattgctttaggatctttgcgatcttcagtggatgggcaaaagtgaaaagttctgcttgagtaaagacctactaatactagtttttttcaataaagtctgtgatagtcttgatgattcttgccttttccctatctgtttcattttacagataatccacattgttacccaaagccacatgcagtgccgggagagcacagttgactgttttatgcagtatcctgccagaagatgctgaccagttctctagtaatagaaagtagtgagattgaattaagagcctatatagttcaccttgccattcgatatactttcactgtgatctgtaagcatattacatacaactttagtaacatattttctagtgagatcttggattgctgcaaggtggtaacagattctctgctttgcttcaggtgttagtggatctttgagtaattcctatggaatggagtctctgaaaaattggttttgatgctgttagcctaggggtcccacagcactgtatctgcctcaaataaatgcttatgtactagttacattagtgtgtttcttttctgtgatatcattatcgcttatagtagcctagcaaccacacggttaggtttaggtggtttggggtgcaaataaattatatagctggtaaaacttgggcctcagtacataattcattgtagcaaggcaaacactttgtgctgattttgaacaaaagtgaagtgtttagattgacgggtgcttttttacctccttttttatatggtaagtagaagatggcattggtgatttattcaataaagaagaatctcatgaagtctttgccttttttccatgttagagtaggtattctcaacacaattcatgtgttctcaacacaattcatgagtttccctatgataatgacaaaaacaaattaaaaaaaaaacttgccacagcttcttttgcattaaaacaaaacaagccaataaaaaacttgccactagcttggctgggtacttgattttgtggaatagctctttgatgttaggagtaggtacagagaaagtcagtagttaaaattttttttgagttcacagatccatctacccccacactcttctacttgtccattcaaaaaaccctcacaagaacaaaaaggaataatattctatttttccgacactaatgaggtgggtgatatgtggtttgtggtatactttactccacaaactcctccaactattgtcctgtctggcaatttttgtgggaattgactctcccacattgtaggcattggctgtgtggagaaagagagtcacatgtggttcgaggcagggacagagggcatataggaatcagggagggagtaaaatgaattgtattcaagttaagtgaagcatggattcagggcagaaaagggagattgagcacctgatctggagcaggagtgctttttatgttttacatcataaaaacttagatgtccctcctttagaatcaatggccacagcattcttgttaaaaaataattattctggctaggtgccatggctcacgcctgtaatcccaacactttgagaggctgaggcaggaggattgcttgaacccaggagttctagaccagcctagacaacatagtgagacccccatctctacaaattatatatttgaaaaacttagctgagcatgatggcatgcgcctgtagtcccagctacttgggaggctgaggcaggaggattgcttgaacccaggaggtcgagggtgcagtgagccgtgatcacaccactgcactccagcttgggcgacagagtcagaccatgtctcaaaaaaaaaaaaaaaaaaaaaaagaaaaaaaaaagtttctagcagaagcaaatgcatatcatgaagtttcataatatgaggacctgctatgggtccttttaatacttataagagaccatattgaaaaccatttgtacagtgtcttcagaatgaggcctctacataactctggaagctatgggacaagtagctttacccaaaacagcataaatgtagccactctcctgtaattatccttacttatttttcttgacttgtctatgcacatagctataaatcctcaggtattcagacatatcttctttttaggcctgtatatttatattaatagcctctacttagatgtgtgaagtttgtttcatgtagtttgctcacagttattatctataacaaagattatggaacaggcactattaaatgatagacccaggtataatttctgactggctgcagaatacagtcatacaaaggtacatacctatctcttttgtactttatcttagaaggacctactatggtcaatttaatttgtaaattacattctcacagataactggagtgtcagccattttttgtttatcagtttatcttttatcatatacatgtaggctgatggtagtttactttttttttttttttttggagacagaatcttgctccatcacccaggctagagtgcaatggtatgatttcggctcactgcaacctccgcctcccgggttcaagtgatttctcccgcctcagcctcccaagtagctggaattacaggcacctgccatcatgcccagctaatttttgtatttttgtatttttgtagagacggggtttcaccatgtttgccaggctggtcttgaacacctgacctcaggtgatctgcccgcctctgcctactgaagtgctgggcttacaagtgtgagccaccgtgcccagccacttattttttatggtggtaaaaaagatgagatttttaccctgttagtaaatgtttaagtgtatagtaatgttaactataagcactctgcttagcttaatttttaaaggcacataatagtggctttacctaaagcaactcatttcttctaggaattttgggaatccttcacaaattaaccttataaacttactagaggggccaggcgcggtggctcacgcctgtgatcccagcactttgggaagccaaggcgggcggatcacctgaggtagggagtttgagactggcctgaccaatatggagaaaccccgtctctactaaaaatacaaaattagctgggtgtggtggtgcatgcctgtaatcccagctactccggaggctgaggtaggagaatcgcttgaacccaggagtcaaaggttgctgtgagctgagatcacgccattgcactccagcctaggcaacaagactgaaactccgtctcaaaaataaaaaataaaaaaaataaaagtaccagaggtgcatagctcctttttacaagagagcctaatttaggcttcgaggtatttatttttccaaacctattgaaaattatgaataaactaaaggcattaaaatcaaaagtaactttttaatttttttattttttattttattttatttttcgagacggagtcttgctctgttggccaggctggagtgcagtggcgtgatcttggctcactgcaagctctgcctccgggttcacaccattctcctgcctcagcctcccgagtagctagctgggaccacaggtgcccgccaccaagcccggctaatttcttttttgtttgtttgtttttagtagagacggggtttcaccgtgttagccaggatggtctcgatctcctgacctcgtgatccgcctgcctcggcctcccaaagtgctgggattacaggcgtgagccaccgcgcctcgcccaattttttacttttttgagatggagtcttgctctgtcacccaggctggagtgcagtggtgtgatcttggctcactgaaagctccacctcacgggttcaagtgattctcctgtctcaacctcccgagttgctgtgattacaggtgtgtgccaccatgcccagctgattttttttttttaattttcagtagagatggggtttctgaggaaatgtgttttctagagagatggaaaattggaagataaattgcataatgggatattataagtaaggccgttaagtctatatgtgtatatatagactatataaccatttcagttaagcacttcttgaaattgcttcttacagtatacacacttgtttctaatgaaaaacttacatctaagtgtggcagtggcatctgtgaaataatagatatgatcaagttgcaggtcttgaaagttgtttgtttgccctgttttctgtacaaccagtatgaggctctctatcattagctggggtgtagacgttttaaaaataatatcactgaattgtaatgcatcaatttgggttttggagcagtatctaacttgttccatttagaggtggctttgcagttctaaacaagaaagtagaatttttactatgattatccctttgcttacaggcttttaaaatgaatatttgttgaagtctcaagtcttttttgccagtattatcttaagactgtgtttgacatcaatacctatctcttattctatgcaagtactgctcttaatattatgactggttctaatatttcatttcaacaagtaatacagctgttctgggtagaacactatgctagacccctttatgagtatgggtgagaaatctataaaataggcataaaccatgcttcatgtccttaaaaagcttgcagtcatactgaaaagacaagattcatgaaacaaataatgaagtcacatatgattcaacagctaaatgagtgatggagacagtgatgtctgtaggactcattgtttgggtagactaatgtgggctaagattgtacaggagagctttacagacaaaataggatttaggctaggtagaactttcatagatggaaaaagcagtctaggcagagaaacatcttagacataggtcaggatgagcattatacagtggtcagtgggtaccaatcaaaagtaggttgaagtgggggagaacctagcaagaaaggggacctgtaaggagactagctataacaagcattgggaaatgaaggtctaacagttgacaattttaaaattttaatggcctgtgagtggcctctttcttggtaaaatttctctttgtctgtttaattatgtctcaccagcacctttaatgttgtgaatgtcatgaaaccttgacaagagactaggaaataacacaagcagtagtctgctctgtagacaaagtgctttcattcttcagtacgcattcagcttaagtcagttagattaacattggttatgtcacactgcctgagtgccttctatgttcagtgatcttttttcttctgaacttcagtgtctcaaagatgaagttagaaaaattgtctagctacaaagttatgtagtttaaaaatactataattatgatacaattaaatggtttggtcactttctttcctcctaaagttaatgaagaaattttacttggatattgcaaatttaactgagataatttaggtactagggattataataattttaggaagattgtgaatgatgacagtcttctttatgaaattaatttaaacatagattaggctaatgggaatgttccttatggttcttcacatgagctttaagaatgctacaactcttaagaaacaatctatataagcaaacttgtaaaggttttatactgttatttagaaacaaaattctaaaatagtttcctgaattacaatgagcagcatatttttagtttatgttgaggaatgattatgctttgaagaaaaaaacaagcaaaattctcagtattttagctgaagatgtgtctttaagacataagtttagaacttaaacttctttttcagtgatcactgtaaaattctattttagtaactcccttctgttattcccagaatatgttttagaatataagaaaattattttccaaatatgggactaatctctggcagattgtaaagcatgagcattgtatcagtatactcaggaaacagaaaacaacactagcgtaatgctcactaacagtgttctctatgtagtcagtttatgtctataagtaaatgaactctccctcctatcatagtcgaatctgcaatttgaattatatactattagagtgaggagaaaaaataccagatgttaaaatagtggtagtacaatatttttgaataaaagttgttgaagaggtagatgttgaccctatgtaataatcatagactcctgccacataatgggataggaggccaaatggaatccagtggtttttagtacagaccacacagaggttcctgatcacttttaatatccgtaaatctttcttaacaaaggtggatgccctcatcaggggagtgggaggcaattttgtttatacagggttgaactatttagatttcaacttcatttttcacagacttcaaacaacgtgcatctcaaataggcaggcacctccatagtgtagagcacaactgggggaaaaagtcagggcttttctgttttgattgtggcaagagaacaagcaaacccattttaaagtgaaaaaaatggatgtaggtctaacgggccctgattcctgtctccattgggctacacatagaacctttgcttctgtttatttccgctcagtctagagaaattcagataagttcttacagaagaggagtgctttagtctttaaggtttctttcactttcattaagttatattcaccatctcataataacccttcattaactcttaactaatttaaatagtttgtaccagtccagcacggcctcaggtccattcattttctcagaattgttatatttaaacactttttacttcaatctctcccaccccaaatttgaagtataaatttaggaaaatcagtcaatctctctctctcttttttttttgttttttgatttgtttatttatttttttggagaccaagtcttgctctgtcgcctagactggagtgcaatggcgtgatctcggctcactgcaacctctgccttctgggttcaagcaattctcctgcctcagcctcccaagtagctggggattacaggtgactgctaccacgcctggctaatttttgtatttttagtagagatggggtttcaccatgttggacaggctggtcttgaactcttgacctcaggtgatccacccacttcggcctcccaaagtgctgggattacagtcgtgagtcaccgcgcctggcctaggaaaattctcctcttaccccttcttcaatatagtttctctctggagctttgccattttcaagagcagtaatcttgaatatttgaaagcttggtagcaccttcattatagaatttttactgtgtaaattctagcaatgtttatcactagcaaagttctttactggtcctgctggttttccatttttgggagatggtagaatgatgggaatggggaggtgtaaatttatgacttccaagtttttttttcaatcattggatttgagtgtctacagcagtgtataaacactgtctaactgggtgaattttggaatcagggcagtacaaatctaaaaagtttctagaattttttccagggtgattttaaagcagagaataaatgagatgtcccattgtaccccttcctcctgtgctttacctgaaagaaggtatctttttctcttatgcatataactgaaaccataagatcattgtggatttatttgatattattgttagttagagactgacctggttatatgtagctgtattcaagatggtaggactatgtgcttatggttttcagtgaagtatggcacaggcttatcttttactctatgattccattcccatggaagattggaatgcttgaaaaattatttggcactatttctttcttctttttctactgttttgttttaaattgtaggtttcaaaatgtttaaataaaattttttttctaatatgtttaaagtcatggatttttgatttagtgtctaagaatggattttagggggttggcagacataatgaaatttcatgcaaagatttgtataagtgcatttttctgattagaagtttcatatctttcatcaggtttccatagaagcttcctatagtgccagcttcttaagaatattcaaggagtttcaactaacattggctgggaaagtacaagtcggcttcacaacacccctgaaatctatccttggactctagactaggacctcctaatggactctagattaagaccccctgcaagctcctcaaatatcttatccccagatatttgtcactatttgacctgtctggcagctccttgggaaggccccattcaccaggcttgtctttatttgatctgactcagtggaaaagccctatcctcaggacatttgttgaaaacaagcagcagcaattgtttagcactgtatctgcctgaggtggctgacttttagaccctgtgcaagcaggaagtgaaggctatggcagaattgtaaactctcagagcattgaaggcatacccaacacagggccctttggcaaaggatgaaagatctcttggttcaaaacattttagaaaatatgtcgatcattagctgaccactaggtagctgaacagatacttcaatggacacacatgacagggaatataggctttacagaactagtccaggaaagtcactaaacaaacagtaacaacaaaccttaggggagaagtgatctgatttccaaactttccactttatattgtttaaaatgtctagttttcaaccaaaaaaattaaaatacaaccaacagtaaactatggcacttaattcagggacgtaagcaatcaataagaactgtcactgaggaagcctagatgtgcttactagatgaaactttaaatcagttgttgtaaacctcttcaaagaactgaaggaaatcatggctaaataaaagaaagtatgagaatattagacatattaggaaagaaagaagcatttatctaaacatattggaaactatagctatgtggtggtgtgctagaggataaatgaagccacagggtaaacatgatgtctcttcttcgaatgtcagttttccagaattaaaactgagagcataaatttgatattgaaacaaatataggtatgttatagtgtagaatgtaaaattcacaaaaataaagcattatgaaatttgccatttgtgatgggccacttacggcaactctcaattcctactcatttcacacctttaatttattttgcctatgatgtacgtcagttgaaaagtttgagaagtctaatctaatgatctgttgcttcagtgattgtggaccaatgacaatcctatgttagaaacaaatgggcatgtcacagataagagataactgtaatagaaaaccgatttccacagtatactcactaattgaccattgtgttattttcacacttggaatatcctacctttgatgaacaaaaggaatacctttacacctgaattgacatttctccaaaaaagacatgcagatagctaataggtacaggaaaaggtgctcaacatcactaatcatcagggaaatgcaagtcaaaaccacaataagctatcacctcacacctgttaaggatggctgttatcaaaaagacaagagaacacaggtgttggcaaggatatggacaaaagggaacctttgtacactgttggttggaatgtaaattggcatagccattatggaaaacagtatagaggttcctcagaaaattggaaatagaactactatatgatcaatccagcaatctcacttctgggtatatatccaaaggaagaaaatagtatattgaagagatatctgtgcccccatgttcattgcagcattattcacagtagccaagataacaacctaagtgtccattgacagaaagtggataaagaaatatacacaatggaatattaatcagccataaaagaagggaatcctgccatttgcaaaacatgagtgaacctggaaaacattatgctaagtgaaataagccaaacatagaaagacaaatactgtatgatctcactttttatgtgaagtctaaaaaagttaaactcatagaaacagttgtatggtggttgccaaggtctgaggggtgagggaaattgggagatactgagcaaggatacaaactttcaattataagatgaacaagttcttaggatcttatatagagcatgggtggtgatgggtgtgataatttgattgtgataatacacagtgtgtatacatataacaaattatgttgtacaccttgatctataaaatctttacttttcaattaaatatttttaaaagggaatacctttcttgttttgaaaatgcttgatgtgtcttttctcacattaatgtaatttagaggaagagaaacagatttgaagaagcctgagccaagggattataagttatccttgaaagcacaaatactatttatcatgcagtttccctcatgaaatgttttacggcagacctgtttatctcatagatctgagtcaaagctgaatttaacacgttaaactttaacttatccagaattagtatcttttgtctaagaaccaacactaaaatatttccttatgttaatcaccaacactagaaatttgcttaattttttttcaaaaacaaaattttgtatcactttttgagttactgcatagtttataatgcaaagaaaacatccaagcttagtgaaatgataggataattactaacttagcaattcattcacacatattaactttaaagtacacaagattcaaattcttcaaattaatttctcaattaaatgaaatacaatgaaatgtaaataaaataattaaatgaaaattaattaaggaccttaatggttgcttataaattcctgaaattgcggattgtatgtccatggagtctgaagatccatagtaattaaaacgtattgtgttatatatgtttatagtatgctcatgctgttttttaaaatatgtatagaacattgaactccacataattgatagcatcataaatatcattgagactactgttgttgattttcatgagtgatttcctctatattatctgctctgtttaagttgattttccaagaagaggtcttaatgactttgtaatcactcttacagtgttttattcattgtgattgactatcagtatttttcctcttgcagcctgactcctaaacccagagtctcatatacaattgtaggtgctacgttaagagagacagggcagttatatggaaagtattatgtgttctttcttttcgcttactcttctctctctctcccccaccaaccacacacaaaggtataaggttgttttcatatcatacctgcaactaaactcattcaggatccccagacctctctaaatgggaaaccacttgtaataggtttaacatctcctaatctagtattagggtaatgctactattgttgtaaaagtttctcataacttgtaatttgctttggcatcattataatgaataatcaattgtatgatataaaatagtaagtgttctaatgaaatgcattttaaaaatgtttgattccttataagacttagatcttataatgaccattttcttatttgatcaaagaaatacactgagaccttagtaagcttccttctgtttagttatgacttcaggtattgaactagatgctgtgcagtcagtcctaccatgactaggatcatttatagtctctcatgttcttttatttaaaattaaagtatgtgaatctttaaaaaaataaagcagtattttaaaaatacttgaaatacagccaaacgtttataacaataaatgcttttttattccatctgttattaaaaatacatttgtttccctgtagtcaccaaaggtaaagtagaatataaatcaaagctgatcatattttctctcttctaattctatagatgtttatgaactttacctagcagcttatgtgtacatatcaccagggattccacatattttgttgggcaattttaagagctgatgccttttaggaagacaccaataccagaatgattttcaaactcaagtaaagagggtatttctggaatattggagtaaggacttcagaaaatctactcccctataaaagcaatgtctggcaacaattgttaaaaacaagtttttcagaattctaaaaattaaccaaaagcttccaacaacctgaggagtgtttattcaataaaatagctgattttcggttaaaaaaaaaagttagatttgttgtattttaacttgccctaatccaatcaacctttccccagatccaaaatatctctggaaactagtaaccttgcatccatggtagctgtgaaaacctgtagctactggagagttgcaagctcctcacatcttatccccagataattgtcactattgacctgtgtggtagctccttgggaaggccccattcacgaggcttgtctttatttgatctgactcagtggaaaagccctatcctcgggacatttgttgaaaacaagcagcagcaattgtttaatactgtatctgcctgaggtggctgacttttagaccctgtgcaagcaggaagtgaaggctaaggcagaattgtaaactctcagagcattgaaggcatacccaacacagggctttttggcaaaggatgaaagatctcttggttcaaaacattttagaaaatatgtcggtcattagctgaccactaggtagctgaacagatacttcagtggacacacatgacagggaatataggctttacagaactagtccgggaaagtcactaaacaaacaataacaataaactttaggggagaagagatctgatttccaaactttctactttatattgtttaaaatgtctagttttcaactaaaaaaaattaaaaccaacagtaaactatggcacttaattcagggaggtaagcagtcaataaaaactgtcactgaggaagcctagatgtgcttactagatgaaactttaaatctgttattgtaaacctgttcaaaaaatggaacgaaactgtggctaaagaattaaaggaaagtaagagaatgatgtctcaccaaatagcaaatatcaacagagaaagagagacgttataaagaaccaaatagaaaatctggagttggaaattacaatagatgaaattaaaaaaattattaaaagggttcatcaacggatttgagctgacagaagaatcaagaaacttgaagataggttaactgagattatcatatgtggaaaaaaagaaaaaaggtagcaaagcctaagagacctgtgggacaccatgtagtataccaatgcacacataatggagtccctgaaggggataaaagaacatttgaaggaataactgctgaaaacttcccgaatttgatgaaaatacttagtataacatccaagaagctccatgtactcaaagtaggataaactcaaaaggattcacacccagatacaatgatagtcaaattgttgagagacaaaaagaatcttaaaagcagcaagagtgaagagactcacaagggatcctcaataagcttaacagctaatttctcagcagaaactgggtcggaagggcagtgggatgacatattcaaaatgttagaaaataagactgtcaaccaatatttctatatctagcaaaactatattttataaaggcaagataattaggacattcccagataaacagaaacagataatttgttgctgaagacctgttttggaagaaatatgaaaggtaatccttcagggtgaaatgaaaggaaactattaagttgaatgtacagaaataaagagtactggtaaaggtaactacataggtaaacataaaagacagtataaaggtatgtttgtttataactcttctatctgatttgaaagacagcagctgcataaaaaactaattataaaactgttgatgggcgtatttcatataaagatgtaatttgaatgacagtaatagcacatagggggagggagggaatagagctataggggaacagagtttttgtatattattgacactggttggtattaatctgaactagattgttttaggttaagatgttaattgtaattcttaaggcagccattaagaaagtgactcaaactagaataaagaattggtagttagctttagaaatttcagtgctttggcatgcaggttagattctgaaagtgaggttatagattatttccaaagttaagctttagttgacaatttcatatgttgtaaacatgtacaagtatattgcctaagtagaatatttggtacctttttagataaacttcaataaaatacagagaaaatttataatcattaattctcagaacattttcatgagttaagaattgattattgctccagtttttaatatgagaaaactataccaaagagaatttaaactttgcctgcctcttccaagtatgatttctaatatggtgggagttgcagtactcaagcatggtttagtaacatatccctctactctcctcaaagtgcttaatgatatttttgatattaaaattaatatctttaataatttcatcacacttctcaagaaactgaagacagtttaaaagtctctttgagcttccctgcctttctttcagaacaatttcaagagaccttcagtctaatgtgaagtatctatcactaaatgtgtacatctattgcccagaaagttgtttttagctcaggtggagtctctaaatagaccgtggaaaattgttttctgaaataattatggcacatcaataaaactgctgagtcttttttttttaaaatagaggtttatggattttagaatttagttatctgttaatgagcaaattaaatgcatccttgaaaaaattaattcaagtattttttttttaagtttatacctaaggcagtgtgggagattcaaaggtagaagagatgtggttcctgccctcatcaagacttcctattaggttggtgcaaaagtaattgcgtgttttgccattaaggacaagtgtaaagagttgtaatatgaaaatggattacctttcataattaagtataacgtatctcacctaatgacttacaaaataacaaagttcagtatcataaataccattataacttacattatagtactgatttgttcctctgggaagaaaatcagcttttcttttgacttggtttgagttctgtttatttgagaaagaactaatgtggcaaaccaaatgaataaaagctctcaacaggttttaacgcatcttgaaccatctgctattagcaccaagccagtactgcaatgtttctggagctggctgtcaggatcagggatgtcctgcagacaaaacaagattcctagtgtaggaagctattgaactggtactctcagaagtgactaccatcttcttccctctccccactagggatcttagtctccttatttagcatttgtttaccacatttcaaaagagtagcttagcagttttttagaaatgtttcagcttagatgtaagctgtacatgattgaggaagggagaaaggacacagtgctagtatatagatagtaaaagtgctgatctcatctccgtgaagtcagagcaacatcctcggggatgaggcttggtctagttatgatagcatactttctttccataatatgcttggaaaaatatttaccctcaaaacaaatccactgtactattttaagcaaattagtttggttttaaatcatattttaaaagttatttaatttttaaattacgaaattttaattaaatgaactgtcttcagagatgattgacctagacacaagtaactatgggaatactgtgatagataaggcttccctgcccttaagaagtttatactctagtaagagagctaagttatacaactcagataactgtaatacaaataagtaagtgccttatataggtataaacaaagcctgtagtagttagaggatgatgactgtagatgggagattttagctaaggtgtctgatgagtcattgggttcacagacatacagatattaagattaaaaggaaatttataaatcatatttccatgaaaaatcctgccttcactagaataagcctacatatttttcagcattggtatttagggatagacagctgttgacctgaggatgacttaggctaatgagttaatttttaaaacatcattacaggggcagaatcaatggtaaagtatccttctgtgtctgggtttataagagtaggtcaaaaggaatggccaggataacaggtcagataaattcaagaaaatcaggccccctaatgtgtcagacattgtgacaggtacaggtaatactatggtcctttgctcttcagtagctcatagcctagcaggagaactcagaatgctagatcattggaagaacttatctctaaatcttatcccatgatccctggaccttctaaactagatgaaggaaaatataccagatggtggggatactttaaaatcttctgacaggaaaactgtgctcctggaatgaactttttaaaaaggtagtatactcacatggtgtgaaatccaaacacacgaggacaatgagatatagatttccctcctactcctttcgcccagctacctaggtgctcttcacaaaggcaaaaactgctgccaccaatttcttgtgtatctttacagagacagtctatgcatatactactagaatttatgtacatatgcatgtctttttgttttgcacaaagagtagcatactatacatacttttctacatctttttttgcagttaacaatcaattttgtagatactttttaaaagactgttttaagagcagttttggctcacagtgaaagtgagagaaaggtacagagatataccgtatactccttgctcgcacatatatatagcctcccccattaacaacaccccacacctgagtggtacatttgttataactgatgtccctacattaacacatcattatcacccaaacttcatagtttaaggttcacttttggtattgtacattctaagggtttggacaaatgtataattatatgtacccaccagtatagtatcatagaattttcactgtcctaaaaatcctctgtgctctacctattcatttctccctccctaacacttacctttttactgtctccacaattttgcctttttcagagtgtcacatcgttggaatcatacagtgtgtagactttttagattgacttcttttacttggcaatatgcatttaagtttcttctccatcttttcatggcttgatatttcatttctttttagtgctgagtaatattccattgtctagatgtactatagtttgtttattcattcacctactgaaggatatgttggttgtttccaggttttagcaatcacaagtaaagttgttataaacaccatttttctgtgggttttgtgtggacataaggtttcagctcctttgggtaaatacgaaggagcatgattgctggagtgtatggtaaaagtatgtttagttttgtaagaaactctcaaactgtcttccaaagtggttgtaccattttgcattcccaccagcaataaacaagagctgctattgctgcacatccttggagatacttctgtatcagcacacctgcaacttcctggttcttttctttttaaaaactatttattttgaaataattacaggctcacaagaagttacaaaaatagtgcagcaaaatcctgtgtacccatcactcagcttcccactggtgatatataattatagtgtattatcaatactaaaaaattgattgtcacaatgtaatcaactagacagcagtacctgtttctttttaatgcctacaagacattccattctatgggtgttttatttaaccagtcctttattgctgggcattaaaattgtagtattgctggtatagggaaagataggagaaaataaagtctgtgtattcggggccactgctggcatttacattgcttttatgtgaattagaaaagagttccctctctgggtggatgtagtcccataggcacatggcttgggaaactagaatataacctagataaatgtttttagcacctctgcatatatatctctttgaacttaagtgggaatacatatgcaggataatggactgtcatttaaattctgcaatataacatcagtgttccaatgtgaaacttcgaagctgtccctttcagatttagcatgtgctcccatcctcctacctgtaaccgtcatcacctctcccaagtaccttaggtcttgtatattttgtgttattattattattaagacagagtctcactctgtcgcccaggctggagtgcaatggcacgatctctgctcactgcgacctctgccttccagtttcaagtgattctcctgcctcagcctcctgagtagctaggactacaggtgcgcaccaccacgccggctaattttttaaaatacttttactagagatggggtttcaccatgttggccaggctggtcttgaactcctgaccccaagtgatctgcccacctcagcctccccatgtgttgggattaccagcatgagccaccacgcccggcttgtattttctattatttatgtacatgtctaccttacattggatagtaagcttctgtcttcttctttatattttctgtcttcatctttatattttctttcccttctcttccccactccactattatcaatctacatagaacatcattttttataaacgtgctgagtgaatttttgtttaaaatttttcttaaggtgaggaagttaagagcagtgaatttttaaatctgcctctcaatacttcaagaggtgtcatgaaatttttaaaccaaaattattttcaattaaagtacccacacactccacactcataggagagaaaaagagtgtgttattaagtcaaccaactcataatggggtgctacagtttcaaaaacattaataagcattgtagtattgaagaaaacggggtagtagaacttgtgacattgcaagcagggaagtattttatatgtattgtacactcatgttcaataagtagaattctgagaagttgcataagtcttgtgccctaaaaattcctgatttcatcagatcttaacttctgtatgccattgatttaggagggaaattgtccatttttaacactggccttttcattactgttaagcaccagaaatattttataaaattttaataatattaaatatttcattaaaacttacatcattggactcatatgtggtacatatcaggactgctacaaacacacaagaatggaaatgtactttttaaaaaaaatgtgttttctattacatagacgttatactagcaatgtaactaaaattagcagagtaatcatacagcctaatcagcacataaatcttatacaagtgacaagttaaaatagataatagtagttgcaaaagtagcttgagatcaatatcgggtggttatgtttgcttgtatatactatttaaggaggtaagcattggggaagttgggctgaataaaacgggggaggcaagggtgagaaatgctctttagatctaatgttcacagtggatcatcaagtgagaattgctttgctagcaacacataaatattttttcattataggggatgactgttactgggaaagcattggagtaaatatttgttttccttgattatttgctgtaaataattttttgtaaccaaatcaacaaagtactgtgagttcactataggatattacattgtaatatagaagttcctgttttcctgatgttaactataatgggtttctacctgtattccaggaaatagagcaagttgggttgattccagtatgttttatttttcagcttcagtgctaaaatcagattgtgtgcaactctgaatcatggttctataaattcttggctatactaagtaaattacagtatatcttccagtacaattataagaatgctgtaacatgcaggatgttttcttgagcgttttcatgattaaagattaatttcttcctgaatttggcttgatagatttgtattgaagagcactgtcaactaccatttgagtgccatctgtgtatttgacagtatactgtggactaataggaatttaacgaataaaatagtgcatttttggtttggcaggatttcttacagagataaataggctgggcacatttgccttgtaggtatgtgtgtttatgtacatatatgtttcatatcaacgttggcctgtaaacttccagtataaatagaataatttaccaacttgttcttccactgggacataatgtaagtaaactatcttttctagctaactaagcaggtggctatttctatgactagtatgtttcaaattttaatatacattgatgtaattaaattttgtgtgtgtctatgagtataatcatctctcattatctctgcttctgtgggggatcctaatgtaaatagtgtaaaatagtaatatccttgcctccttttcttgactttttccctcattctgtgaactggctttatgtgccttctgtaccttgctccagtgccttaagtggtcagaagtgggtgactaaaagaggtagaaattgccacatgtggataatggggagttgggtatttatgataatacatgggaatgagggagacatattaataattttgaagttaatggacttatttgttgagggaaggattcatggacagttttgaattatgtttcaaatatggatttagaattttatttagggggagaggactagacattctagtcagtgaggatcataaacagagctgagtaagtagttttgtttagagagctgttgggaaataagtatatttgagaattcttgaatcaagagagagaagagtggagtggcttaaaattaaagcatctgtttattcattttgacttgattttctaacctatgtgggaatgctgtagaagttatatggttgaataagtgagggattagacacatttaaatcagagtcattattgaagaaaatatcagaatagtttagtccagggtggactctagtctacataagaattagctgtgagattagatttgtgaggaaagaataagtacaaacaatagtacaggaaagaaatggtatagtttggcatttaactgaataatgtgggtggtgatctagaggctcatgttaggctagcattgtttatccaaaaagaagggctgtaccatttctaatgaatttggagagctctgtcagccatacattgatgaagccctgcagtaatgtctatgattttgcttgcagttatactttgaagatctccagtattctgtcagtttctgagagcgcacaatctgactcttgaaattctggtagagcttgtgaggagaaatcaagagaaattgctgagaacctattatgtggtgtgcatccttctggatgttttacatacctgctttgcttccctgtttctctaccaaatcaaatcttctgtaaagatatatgagggtgggtaggtgaatgggcatcgtgctgagggagaactctccactcttcaaagtttttgccacctaaaaaatgccaaaagccatggtgctacttcagctctttgtgagatttctagcctgccttcttcctttactctttttgatttatgctatctgatggctccaagtcacagatactgagctaaagtcctttctgcagtcatggtcctctttcttgcttccctgaactaccaaactggctaagtgtctctcctttgtgtcccataattcctcattcatagctattttcttatcatttactgctgtatattaaattctattcatgtatttctctccttcacttattagagtataagctcctgaagagtgaggatggtctttttcctttcttatcccaagtgcatggcaaaaatagtagagaaggtgcttaataatggtttcttgtactaagttgaccccatcaactgcagtttggcttctcatcttgtttatccttgtgggatggccttgtacactgtctaaaccattctctctattgcgaaagaatggggcaaggaaacttcttagctttctttttagtctcttttattccagccactctatgctttgaatacctagttttgacttgcttcccggtaacagactaagtctttcaggggtatggtattcacaactctaccctgtactagacagtgtcatgtagactagtaacttggaagattaaggtataagaaattgttgaggtcgggtattctgagcatcagtatacacactgatttcttccccagaatggtgatactcaggaaaccagggagcccctggttacataaggaagtgtgaactgctgcagatagaaattggaacaagacatcctcattactgtaactctgaggtctaatagatgtcctccctacaactacaacaaggtggtctgtgttttccaggattggagaagaaaccaaaacaatttgacagtttttgtcaactaggtctggaggcacttccctgaagtaaaaagatcatctgattcaacgactcctcctcagtctcagtcacattaggtgactacaccagttagtgtgtctctgcattttggttctatttgagaaaaatgtttctgtatggaaaggtaacacaatagtaagagatagtttatccttcatcccctcttttgacaccctactcttgaattctgatagctggagttctttttcttaaacccactaccttcacaagaaggcaaactgtttaaactcacctatctctcacatgatagtagctggtctcataattgacagaatcattggcagtaagaccattatctcttttaaccagtggttgaaaattctacttagttgtctattggagctcaagaaactattaacttatgaacgtaatttagtattgaagcaccttgtgggcctcctggctatcaaagataatcagataccccaaaaggacccttgaactggtatcaaaattcagtagtaactaatgtaggatactagggattagcctcatgattttttttaactaaggtctccagatggccaatgaatttatgaaaccggaaggagctggtggaatgggaggacagagaagatgacgttaagtaactttgcatacatgctctaatttttttttttttttttgagacagggtctcactctgccacccaggctggagggcagtggcacaatcacagctcactgcagcctcaacctcccaggctcaggtgatcctcccacctgagcctcccaagtacctaggactacaggcgcacaacaccatgcctggctaatttttgtaaattttttgtagagacgggtttttgctatgttgctcagggtggtctcaaactcatgggctcaagtgatccggctgcctgggcctcccaaagtgttaggattacaggagtgagccattacgcccggcccatgctctaattttttaatggtcatgtgcccattgagcattcatcattcaggtgagtcataactagagactgtataagggtattgtgaaactctatgcagttctttagtcatgctggggttgggttcttttaaaaacagaccatttccagatagtaaccatatattctggatttccaggacagccctgatttcattttgtcccattgtgtccataagtatacttatgttcgttagacgttatgccagtttttggcttggaaaatatggacatcaggcatataaggacttccttcttgccaactgaaaacagttcatcacagcatagccttgctctttcaaccctgccatcctaactgccagcagtctctgattttgctcccatcttgtatctcccacacttactttaaccctttgtgagttaatttatctcttttctttggtgtctccttgcctctggagtccagcaaattgtgtatccttatactctcacaaagctacttgtatcctagcattttggtaataggatgtactcttttgaaaaatgggacactttcttttttcccagggtgctcttgggggttgaaaactgttctgtgagatactcatcttcagaggcctccgaaaacacattcagtaagaagcagtactactactactaccatgtattgagtgtttactatgtatgagaagttgggtaaaatatttttaaaatctcatttaatcctaaccacctgtgagattggtagtgttcccttttcacagataaggaaatatacttagagagtttgagtttttcaagattctgcatttggaaatccttgctacattccaataagatattagttgtgtacataccaggcttagaattgtggatgaactaccaatgactccaaccccattatagaagaaatttcacctttttacttggtaccaccaggaaataagtatttctatactcttggtagatgaatttttatacattcttcttgtataccactggtcctcaaacttgagaatgcatgaaaaccacctgaagggcttgttactcccagtttctgattcagtaagtgtgagaattaagtgtgtaaaattaaacttgagacttaatttctagtaagttcccagtgatgccaacgttgctggtccagggaccacactttgagtcattgttacatactaattattttttattcagcaaatcattattcagtacttatggtgttctaggcaccgttctaagcactgtggatataataatgaaaaggttaggcagggtctttgttttcataaagcttatagtctagtgggacagatgactaattttattgggataagtgaacagggattgccatagagaacaacagagttgctatcctctactttagatgggttgagaaccctgtctaaaggatggtagttgggtctctttgaggaggtgatagtctaagacctaaaggatatgaagagctcatatggctttcacgcttgaattttcttagctccaacttctgttgccatcactggtgatgactaccttgggagaactccatgaatttcagactgacccctgtgtaattcattctttggtactttgtgtggccttggccaagcttgactgaatagttcctttaagattgtttaccccctctccaccccaaccttcccccaccatccagtatagatacagaagtcagaggaattttaagagtgggctaattttgtcttctggcttcacctagatcacattctttggtatatgatggcttgagaagaatatatgctaaggaattgtgcctgtgaacctgccattcatggccactgcccttaccttataactatcaatgataccttaagattctgtcttaattgccagtttgcaaatttgcctcaaaaggggagacagtgtgggaatctccacaactccttagctaccctgatgttaggtttctctagggaagatttctagattcatgcagtctaagaaggtgttgtcagagcaacacaaaaccaaacttcccttccagttgtggtgactaaagctggaaaaattctagatattcgaaggagactttctacggaactatcatgatttcttgccttcagagttttagttctgaagtttgatgccttactctttttttcccccctctggttctgtcctaccatgacttaaccagcttttcctttgaatccctcctgcctctggagccatttccttgctgtctagtttcattttattttttatttttatttttatttttgagacagagtctcactctgtcacccaggctggagtgcagtggcaagatctcagctcaccgcaaccgccgcctcctgggttcatgcgattgattctcctgcctcagcctcctgagtagctgggattacaggcctgtgccaccacgcccagctaatttttgtatttttagtagagatggggtttcaccatgttggtcaggctggtctcaaactcctgacttcaagtgatccaccctcctcggcctcccaaagtattgggattacaggtgtgagccactgcacccagcctcattttattttaattaaatattttctctggtattctgttcctttggaggaaaagagacccttaccaggtgctacggtatgaatatttgtgacctcccaccagatttatatgttgaattctaatctccaagatgatgctattaggaggtggggttatttgggaggtgattagatcacaaaggtggggccctcatgaatgggattggtgcccttttataaaagaggcccaagggagctcattcatccttcccactgtgtgagacacagcaagatgttgttgtttatgaggaatgggcccgcatcagacactgagtctgctggctccttaatcttggacttcctggcctccagaactatgagaaataaatttgttatttgtgagctacccattttatggtattgtaaatagtccaaacagactaagacaacagatatttctctaggtattttcaggcagagcatttcacttggcctaggtgtatgtatttttggatagcagacttccttagtcttctctcaataaattcctgaaccagagaaggggaatatgagtaattgacttttctggttgccaaagatgtctttagtttacatgaaaaatgttttgaacagttatccagtgcatgcttaaatgggctgtctcttataacacatctgcacatacaggccagatttaactaccttacccagattgaaaatttccttttccttgtggactcagaagtttcttcctgctagtctggttcctgatggtatacagtggataaacattttttttttgttaacccatatatcaaccataagaatgactgaaataaaaaaggaaatggtgtgccagctcactcatagctggagatgataaaccttttctgttgctttagagccagatatccttggttggtagtgtcatgtctgctccatattaacagtgtcttgggcaagtaaaccaatcttgccgagaagaagaaaatgcatatgaaagcacctaatagtacttaattcataatatcataatatgctctcactgaatgttaatgcttgctttcctccttgatgttcttaaagccctgaaacacttgattgagcaaggcataatctctcatggtgtaccccatcagcaccataatcttacattttccagatatggaatccgtttaagaactacctgcttaattatatttattataaaaatgataatctcagagtatccctacttcttcaaggtatccaagaaaggaaattaacaattttgggcgtctacctagtagaggtctcattgacccaaaatgatgatagcattaataattatacctttattgacagaattataatacttagcagtttccaggaactttttaatggatagcgtccttggattcctgtagcagttcatcaagtaggcagtccccatcttgcatatctgtgtccaaggatgaagggaataggatgattccttcatggtcttttgactgatggatagtggagctgagctttgggcctaagtcttctgacacccctcctttccctgccctattccagcacttttatccaactatgccacatttttttttttaatctgaggttctggtacatgatttctcaaattactagaattctaagacaaaatgtttcttaggtttcacctcattttatctctgagatgtttatgttcctaagagatagttcttacgtgtgggagttttaaactctacctagaggtcagagaaagctgtttatgcctttgatgtaaattttgtgcaccatacttagactatactacacattccaaaacagtatttcttgggcctagacttgtaacaaaactctctagtgtgatgtattctcattcactcttttatattaacctattttattctttcagcaaacatatttagcccttactatgtgtcaggggataggaataggaccgtgcaaaaagacaacctctgttttcttggagcttacgctgtagtggataggaaataagcaaatgggtagtgatgtgtactgtgaagaaaaataaagcacttttaaattttcgcccaagccatgagattactaaattgtggtatctatcagtgaccccttgtagaccttatagaccttctaaaaagttagttattgagaagatggcccaggaaaggaacattgtctctgacatccctgtgcagtttctaccttcttttccattatttgaactaagatcttgctttcttgtatggttgtgagcaaccctgatcgagtggagtgtaagggcatggccaaacaaagacagattggagaggaagcctgttaggaataaagcaccttcggagaaacagtctcacaacaaatactgttagagttgtatttgtcatttatcctttaaatgtaatgtgttgccttatagagtgtcacatcaagaacactgaaaagagatgtatttcaaaatatgtatttagctatacaatggttaacaaaacacagcataaaaagcagcctccttaaatgcttctagttttatggtgtactactgtagaatgagttctttttgactgaagtgttttaaaagttttgaagaaccagggagtctgcaagttggaaagaagccattcttaccatgaggcaaatatacttgagtttaatttttaaactataactgctgtttgaccttaaattaagacagtctgttttcattgtggtgttttactggtttaacaatgagaacatttaaagcagctgccaccaattaaaatgattcataagtgctggttgtaaataaatattcttgaaattttaactcagtgaagtcagtctttttagtggcactttctttctggaaagcaatttggtaaaatgcatcaagagctataaaaatgttcatacactttgatctggtaattcagtttcttaaatatccttagaaaataaaactgagatcttgataaactttaataaataaagatgtccctcacagtttatcaaggaaatagttgcctaaattatggtctacctatatgatgtaccatggggccattaaaatatttttgaagagtattaaccatataggaaaatgtttatgcaattcagttgaaaaacaaaactatacaaaaccatacagtatgatcctaaaaatgtgaaaatatttccatagaaagagtgtcaggaaacattatacattttcattttctttgggtagtgagattgtgtatgatatttattttctcctttctacttttctgtattttctagaattttttatagtgaacatgtattgaatttatagtgaataaaaatgttatataagtattttaatcctttcaataagggtgccttttatgaatatccagtccatttatattattatgacctaattttttccacattttcagctttagagcatttttttctagtgaatttttgtttttaacgttttaatgtttatttttatggcacataatgtcaacaattttacctctgcttggtctaatttctaggtattcttctttaaagccaataattcagttccttgttggaatattatttttcaggtggtttacatcaaacagcacacacattcgtagtatgtggtaaagagagttgactctggagccacaatgcctgggtccaaatcttggccctaccacttagcagctatgtgaccactgacaagttaatggctctctctaattctcagtttccctttctttaaaataggggataataatagtatctacctcatagggttgttataaggatttcaaagagttattacatataagtacttaattttaaaaggcctggtatatagtaaatattcaataaaaattggctatttttagtagtgtgtgtgcatatatgcacacatatacacatacatattttcatgataatttgaaaaatgcccttttatatctgccttttcttttatacaattttaattttaaaatgaagggttttatcttattttcagataaaattagtttttcttatatgctttgaaattatttcaaaaagttttcagcaatagaaacctggtttgctttcaatcatattttttccatatttgtaactgatcattcacgtgggctggatggactgaagatcagcttcattctaggtataaaataacttttatttacatacacaaagttgatatattcataaccagttaccctcatctattatttacctcatttattaaagtactgctttaatagagaaggagggggatgggtaggtgtcagtatacttcaaaaataataaaactacatttgtttctttttaaactttataatccagccttctctaatcaaactgatactcccagaaagatttggagggaaagagagctaccttttattgaatcacgtgttgggctagactcttacatgtattatataattctgtagtccaatatgaaaactattttaagtaaagcaatcatttggcaattttactgtcctggattacagaatcacaaatgtgttcctatagaaaacaatttggatttaactgattaactgtttattaaataactaattgcaatagtttttccattattctgtttcatttttttgaaacaggtgtttctgtggtatgtttgcattggcagaataaagaaagaatctgggcaagtttgaaagcatgaaactggtcactgaaagtttcttttcaagaatgaagcatttttttaatcaatctaataatattcaacagagacacatatagataatccagatatcttcatctttagctggatatttggttagtatttaatgccaagaaggagtgtgagaagtagtccctgtgggaaattgtgttttctttggtctttggttctacagctatgtagaaattctggattgagtatgaagtttatttatacatgtacatgtacatttatctgtgggatttatctaagaagcagtggtttggggtattgttcttgctggtgaaagaagtggactgggtggaactctagagaaaaatttgcttttagggataaacatgttcaatagctcaggtggcaaattttgctttcttgtattgatgtgataagctgagtgggtcactgccatttccagaccatatacaccacctttggctgatttgtcttctgtcatgtacctagcagttcagctggaggctttttaaaccaaagtatttaaatatacataggaagttgttgtactggtgcttattggtggctactgtgttctttcttatcttcctagggagtgtggtccttttgtttagcttctgtttcatttgtttacaaagttataggctttgaagtaggcagttatatataggattgcctaaagagacgtggaaagtgagaagtctgctttataagtaagcaattatccttatttcactgccttattacctcagtttctcagccagtgtctttcatgaatttggcttttctcataggcttgacattggcttacttactgctatcctaatttttttgtggaaacttacttagttttgtgtctcccagattagatactagctcagtttactttctgaacatttaactatcaaagctttgcctgatgtgttagtgaggaatttttaaaaaataatttttgataatttaatgatacacatcacattattttttctatttgttccatcataaaagaaattttcatatctggtttccttaatgtagggttcctggccttaggtgactgtccttctatagatatggcattgttattacaagatttgtactggtaagactatgataaatttagtgttttctaggacagtagtgaggtaaatagctgtgctgtaagattgtttaaatcatcatagctgaaaaaataggcctttaaaaatagcgataacagaatacacatacattagacataatgcatgactattaatgacttcctcaagatcttttaggagttatgaataaggtcattcagattgcactttttttaaactcatggagagagtataagaggagtgagctatttttggcatgggcttaaagaaggaaatatcagtgtgactggtaactgacatgtttgtcaagttcagtttctacctgagtgctttaatttcttttaaatttcattactttggactttagagttctcagtatgaaattttttaagagtgacttgtctaacctttgggttctgagtagtgtgttgcccctgaaattggttgagtcattttatattcttctaagagttcaccacctgtcaaagctgaagagatctgtcccttttgccctttatttcctgaaccatttttctttttttattattattatactttaagttctagggtacatgtgcacaacgtgcaggtttgttacatatgtatacatgtgccatgttggtgtgctgcacccattaacttgtcatttacattaggtatatctcctaatgctatccctcccccagccccccaccccatgacaggccccatgacatgtgtgatgttccccaccctgtgtccaagtattctcattgttcagtgcccacctgtgagtgagaacatgcggtgtttggttttctgtccttgcgatagttgctcagaatgatgttcctgaaccatttttctgctggcactaatcttatttgtgataggttttcccacatttaatatgtaaaacctaccacagagtttgaaccttaatgtgacttagggttaaagggctttgagacttctacttttgtccatgaaggagtaactggtgcaagacttgctcctttccaccttacatctcccataaacaactagaaaccagacaaaatacatgaaacaactgtttttagacatcgggcaacagacagcacaggactgtggtcactgagagaaagggaacaaacgaagtgagctctaccatcaccctgactttttgtcagcaggcagtttctagaccacagcattgtgagggggaacccaagcagaactgcaatcttgctgaattggtgagacagagataggaactcagggaggcctaggtggcagaaatttatggagcagagtactggaggaggaaagctactcagagacatagctccagaaatctgcatagatgttccccttatctctggctgaatatgaatctgtgcatgtatcaagggcaacactgtgaggctgggcagaaaacaactgctcaggagctataagctgaaaacttaccagagctcatacagacctgagagatatatgagttcctacagcaagagttgtgagcccttgttgaacacccagggcattccagagagactccagaagggtcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaagcagattaacctacttgcaactggagtcccataaggaaaggagagagagaaataggcagaaaaaaaattgaagaaataatggctagaaattttccaaatatgatgaaaatgtaaatccataaatctaagaagctcaatgtatccaaaacagaaaaaccacactaaagcaattataattttttaattatttatttatttatttatttttgagacggagtttcactcttgttgcccaggctggaatgcaatggcaccatgtcagctcaccacaacctccgcaccctgggttcaagcgattctcctgcctcagcctcctgagtagctgagattacaggcatgcgtcaccacacccagctaattttatatttttagtagagatggggtttctccatgttggtcaggctggtctcgaactcccggcctcaggtgattcatccacctcagcctcccaaagtgctaggattacaggcgtgagccaccatgcctggcctaaagcaattataattaaattgttgaaaactagtggtagagcattttgaaagccactaggaaaaaaaggacacattacagaggaacaaagagaagaaccatatacttctcatcagaaacaatggaagcttccagaagacaatggaatgacgtctttaaagtgctgaaaaaaaaatactgccaatctcaaatttgataccaatgaaaacaccctttaaaaatgaagaccaaaagaaatgaaggtgaaatatatatttttttcagacaaaaatgaaaagaattatcactggcaaaccttaactacaagaaatttaaaggcagctgtccaggctgaaggaagatgataacagatggaaacttggatctctacaaagtaatgaagagtgccagataaatgtggcaagtgtagggtaaatataaaagacattttccccctcattaaaaaatttctttaaaagttaagttattatttaaaggaaaattaataatctattataggattatatggtatatagaagttaaaggtataacagtagcctcaaaggatgggaggagttaaatggacgtatacgttaaggtctttacattgcttttgtagtgatataatattagctgaaagtaggttgcaataagataaagatgcatcgatacaacctagaaaaattactaaaaagggcataactaataagctaataatggtgataaaattaaatactaaagtatactcatttaatcttacagtaaaagagaagtggagaacaaatgggaaatatagaaaacaaatattggatgtaaagatggtagacttaaacccaactctgtcagcagttatattaaatgtaaatagtctaaccactccagttaaaaggctgcataaaaaatgcaagacctaaccatatactgtgtataagaaacccactttaaggataaagacacaggtatgttaaaagcaaaaagacagaaaaagatatacaaacattcataagaatgctagagttattatgccaataagagatgaattggacttcaggacaggcagtgttacgaggaatgagggccatgtcataatgataaagtggttaactcaagaagacaaaatactaaatgtgtatgtacctaacagatcctcaaaatacatgaaagaaaaaaaatacacataaaaggataagtagacaaaactacaattagagttggatatttcaacattattaattcagtaattgatagaacaagtagacaaaaatcagtgaggagatagaaaacatgatcaatactaccaaccaactggacctaactgacacttataaaacattggacctaacattaccagaatacattttcttttcaaattcacaaaagatctctataaggagacctacaaaacactgatgaaaaatcatagatgacattaacaaatggaaaaacatcccatgctaatggactagaagaatcaatattgttaaaatgaccatgctgcccaaagcaatctacagattccacacaatcactatcaaactaccaatgtcatttttcatggaattagaaaaaacaatcctaaatttcacatggaacaaaaaaagaccatgaatagccaaagcaatcctaaagcaaaaagaccaagttgagagtcatcacaccgcctgacttcaaattacactataaggctatagtaactgaaactaaaacagcatgatactggtacaaaaatagacaaacagatcagtggaacacaatagtgaactggatataaaaccacatacctacaaccaactgatcttcaacaaagtagagaagagtaaacactggggaaaggagtccctattcaataaatggtgctaggaaaattggctagctatgtgcagaagaatgaaactggacccctatctcccaccatatacaaaacttaagatggattaaagacttacatgtaagacctgaaactataataatcctagaggaaaacttaggaaaaactcttctggacatttttctaggtaaagaatttatgatgaaaactctaaaagcaaatgcaacaaaaacagacaaatgaaacttaaaagcttctgcacagcaaaagaaataatcaacagagtaaacagagaacctacagaacaggagaaaacatttgcaaattatgcttctgacaaaggactaacatccagtatctacaaggaagtcaaacaacaagaggggaaaaaccccattaaaagctgggcaaaggacatgaacagaaatttctcaaaagaagacatacaagcagccagcaagcacgtgaaaaaacattcaacatcgcgaatcttcatgcaaattaaaaccacactggggtaccatctcacaccagtcagaatggctactattaaaaagtcaaaaaacaacagatgttggtgtggatgtggagaaaagggaacgcttatacattgttggagggtatgtaaattagttcaacttttatggaaaacaggatggccatttctctaagaactaaaaatagaactactgtttgacccaccaatcccactactgggtatctaccaaaaggaaaagaaatcattacattaaaaagacacctgtactcatgtgttcatcgcagcactattcacaatagcaaagtcatggaaccaatgtaagtgtccatcaacaattgactaaataaagaatatgtggtgtgtcatgcaccatgaaatacaatgcagccattaaaaaaagaatggaattgtgtcctttgcaacaacatggatagagctggaggtcattgtcctaagtaaattaagaaacagccaaataccatatattctcacttgtaaatgggagctaaacagtgagtacacatggacataaagatggaaagaataatagacactggagactccaaaagtgggaagggtgagaggggagtgagagttgaaaaattacctatccagttcaatgttcactatttggttaatgggtacactagaaaccaagtccccaccagtacacagtatacccatgtaacaacaagcacatgtaaaccctaaacctaaaagaaaataaagacaaataaaaaacgcttaactgttttcattgttttgtttgaagtgttacgaattccctgaccatcctgcatacacagtcaaatggaaataccaaaacaaagttccatacaagtttttaatggcataaaaaataggagttgactgtatcaattaatattcattctaaaatttctggacctagttcttctgttattcttagttttgcttaacatttagcttaggaatcggaagacttcaatagaagctcttttttgcctgatttgttttatattaaaataattaattattattatttttttgagatggagtcttgctctgctgcccaggctggagtgcagtggcccgatcttggctcactgcaagctctgccttctgggttcacgccattctcctgcctcagcctcccgagtagctgggactacaggcgcccaccactacgccctgctaatttttttgtatttttagtagagacggggtttcaccatgttagccaggatggtctcgatctcctgacctcgtgatcagcccgctttggcctcccaaagtacaagcgtgagccactgcgcccagcctaaaataactaattttttttaatagtaaagactaagtctcaaaccttaaagccctttgaacaaatgggttcagaataggacttccaaatagaaattacttcatttttgaaatctatagcaaaatgtcatttaaaattaagttgtattttcaggtaatagagatttctggtgtgttcctattatcaggaaaaaaaacccacagctatttttccctttaaatgttctcagtgtaaactaagaaaatatgtgcaaaaatactatttttttccaattaaggtagtctttctcatctaatttagggctctaaaaaactataagattgtctcagcatatcaaatctgggactaattttttttttcgtttgctgaaaattgttgatttgctcttgttaaaggaagaaatggttctttcagttcaaaaattggcagaatcaagctaatcccttaaagtatgcttgtgctttggctgattgtatgtctgtggtgattacccttgattaacaacagcaaaaaattctaccttcccaatcatctgttagactttagtctgccttccttcctctggcatttgccagttaaattggaattatataaatgggagaaagggaatataatgctgctatgatagaatttcttggaacaccaggcaaagaaaagtattgaaagattggtcctgatccccgctttcagatatttgtggtctcctatactaatttatgctgtctatctaagcagtatgatcttattttcctgagccctgtggggtacaggctatttattatacaaagcttggagggaggagtgtggtataaggatacagtggtgacttagtgcattttctttatctacagcaaatggttggatgagaaatgcatctgaatcttaacttctcgaccctgcctcagattagccccctcccatttctctccattcctctcaatttgaatttcatattatctggaggagtctcattcattctataatatgaactacttaatcaaataatcagatcaatacctagctgaggagttgttaaccaatggtataataaatggaaattttgatttggaggaaatttgtatttaacagaggacctgggtttgatgaagtccagctagacaacaggaaaaaatgaagtgagaaggctgagggagatcagaaagagtgctgggaagccatcaagcataaaatggtaggccttgctgtgggcttctaatggtgataatgtagaaacttataaattggggctagtgtttctaggctgatgcagcatttctagtttgtcctggtgtcttctcagctaatctttctctctcccctactgggagaaacaggaggaagaggagattgtgcttatgctcacctgtgtggtgctatgtagtattcataggattttcctattctttggtcttttagaagacacctaggtttgccactcacatttttttttcctgtagtgggggaaaaaaaaaccatattataccagtagtaagaaaatttggaggacttgccaggttctaacactaaccagtttggtgattctgcactgtctgcctggatctctttttgtttttcacctgtaaaatgaaaagcaaatggattatctcttaaagactctttcagtgaatgagcttagatacattgttatatacactttaaactatgtactaaagtttgggttagggatttgtaatggactgaattgtaaccccccaacctctacattcctatgtccaagccctaacccctaatgtgactgtgtttgataaggcctacaagaaattaattaaggtttaatgaagtcatgaagatgggggcctgatccaataggattattgtccttataaaagactgttggagagctcgtgctctccctctccctgcacacactcagaggaaaagctatgtgagtacaaagtggccgtatagcagccttaaagcctagtaaaggaagagagcctttaccaggaactgaactctgccagtaccttaatcttgggctttctagcctccataacagtgaggaaataaatttctgttgtttatgccacctagtgtatagtattttattatggcatccctattacatgatttaaccatgttaggtatgtttttatgaattgaatctgtagtttatatgatttagaaatgaaatgtaaagcttctttttgttgaaataggaagtgaaaggtttttacctggtggtggaaagaagacatcatcatttctgtacttctgcaagctgctagatcctggggaattatggtatttttagctggatgttatgaggaatatagttgtatttttgagctaaattgctgagaaacctgaatacagttgagaaacaatcattatttgatggcagaagaacagaacaagttacagggcttctctcttttcctgtatccccccccccaatataaataaccttgttgagtaccctattctattaattattataattattattgcattggtagagattgatgtaattttgttaatgttgcctcctataaatctcattctaaagaatcttattctaaagaagagcaaattgccagagtctaagacttttttgtaacctctgttttgccttgatatggcaggagagatagggtttaaggtaaaatattattaagtaaatacaccttttttgttgtatcacttaattgtattctgctcctgcaaacatatttctgatttgttctggctcacatcagtagatggggagtgccctgttcagatttacattgcttttcgtacttttgctgattgtatgcaactacatttccctagagctactgttgacctgacagtattggctgctagttggcagggaggattcatcatctagattagatggttacttcctgttcctgtctacagacatgaaaaaatggagtgtttacttttctccaaaggtttctcagaagtaggaaaattactttaaaagctttgtctggttgccttcagataaacattttcattaatatttcatctcattttgagccctcttctagtttgtagtattttttcaatgtatgtaggtggcctcaaaccatatggcaaaagcatttcccaaaacatccaatctttgtcttactatgaactggttttctgtattttttttctcattgagcagctcctctcaacaggctcaaaaccctttttctactttgatctgcctctgattatgctgatgtattaggtcctttttggaactcatacatgttttaatagcacatttaaaaatgaaattgcctattccttccctctgtgttgcgtgaagaaaaaaatttgttcctatttttagataatatgtgttgaatgttctcgtagtcattgccctgtacaacgtggttatcacacacaagatacaatgtcttgtgctcagggatgtttattacgtttctgtctactttaaaatgcttaacttcccggattcttatccccattaaatgttgcttttaggtattttagttgtttttaattccatacacgtgtactttataaaatatgttggatgagcatttgtaatgagaaattagagtcccagatttttaatgaatagttttgttctgtctactaaaagtctgacttcttccatcttcaggcatctgtcctaaacacagtgaggttgtggagtagcactccctcccatctttgacacagatacttccccgcaatcccaactcccaaagtggatgttgcctggggtaggtaaggatcagggagagtatagatcattctgtatctgctctacgtcttatgaaggctcttgagaacacatagtccacagtgcttcaaattcaaagaaatgttaaatctgaaagagcccatagcaagttatcaagactatcagactacttcctgtttcctgaatgtgctgtgcacttttacatgtccatgcccttgcttgttttggagcatctttgctcctcaggctgccttgtaaaatgcagcttgtcctccagcaacttaagctctgaattaatcattctgtcatcagtgatagcatggcattataagaaactattaatatataatttctcccatcttatgtttgagtgccctacaacgtatttcatagtatagtgtttagtttgtgttatttttctactttaagttttaaatgtttacttgagcagatagggttatattatagtaagaatggtgtatgtatatatttcctgggataaataagaaagtagaaggtaaaacacttaaatgactttcatttctagcgtttttgataggaaatgaattcactcacacttttaggtttctcatggaagtcattgaggaagagaatatacaacgtagttctgccttattcagaaaccatcatggtattttaaaaacatgctattatctatattacattgtgattcacttcattctgaagctgccaaaagacctgtcttacatagagatactttggatagccattgttacgggagaggattgatacatttctgtatttctgatttcttaatttatgatcatatgctacttctgtgatcaaaaaataaagtttttttttttttaaaaaaaaagaagagacaggatggcgatcattaaaaagtcaggaaacaacagctcctggagaggatgtggagaaataggaacgcttttacattgttgggagtgtaaattagttcaaccattgtggaagacagtgtggcgattccttaaggatctagaactagaaataccatttgacccagcaatcccattactgggtatatgccgaaaagattataaatcattctactataaagagacatgcacacatatgtttattgcagcactattcacaatagcaaagacttcagaccaacccaaatgtccatcaatgatagactggataaagaaaatatggcacatatacaccatggaatactatgcagccataaaaaggatgagttcatgtcctttgcagggacatggatgaagctggaaaccatcattcttagcaaactaacacaagaacagaaaatcaaacaccacatgttctcactcataaatgggagttgaacaatgagaacatgtggacacagggaggggaacatcacacaccagggcctgtcggggagttgggggctaggggagagatagcattaggataaatacctaatgtaggtgatggattgatgggtgcagcaaaccaccatggcccctgtatacctaatgtaacaaaactgtgcgttctgcacatgtaccccagaacttaaagtataatttaaaaaaaaaaaaagagacaggctgggcacggtgtctcacgtctgtgatcccagcactttgggaggctcaggcgggcagatcacgaggtcaggagtttgagaccagcctgaccaacatggtgaaaccccgtctctactaaaaatacaaaaattagccaggcatggtggtgcatacctgtaatcccagctacttaggaggctgaggcaggagaattgcttgaacccaggtgacggaggtcgcagtgagctgagatcgcaccactgcactcagcctggcaacagagcaagactccatctcaaaacaaaataaaacaaaaaaatggttgctgatattgactatgccagattagaaactgaaaaatgaagaggtgaatttcatccttaaagataaggtttaaattttaagatactggtatttatatgagtaatgaaagaattggtgagaaagtaatcccatctaattcttgtcttcctgatcagtggttagtcaagaacaattggagaaaaattcccaaatggagcattagaatcttggctcaagttataacaggtttattgcatatgatatagaaagcaaaaaaaaaaaaaaactggcttttaccttttgtttgttattttaatacctttagtgtaggtcatccttcacttgaatgctaatgttgacagtaacttgaccttacacttaagtcatctttttgaatgccactggacatttggctcttggaagatggtaactcttagtacttctccctggtttgtatatattacttatttgggaacctatctgccattgtggctgtcagagctcagcataatttaaatgtttaaggagggtgattgaagtacttgaatgagatatcttttcatctatctgctgatgactcactaaagagtattttgaagaaaggatgttctccaactcaccagtgtattagaggaaaaaaacatatggtatatccccttaaaatttaagtttttagaaagcagaaatgcattattccagtattactgtgaatacttatattaccatagaccatccccattgtaaggtacttatctttttataaaatgtcctaaaatgggtaaattatttcataaaaactggcatacaaagttgctctaattagaacgtaattgtttttagacttaaccattaattgaggctgtcagtagtttgcagcagaatccaagcatctactgtattaaacttcatctaaaaccacgttattcttgatgatattttgttataattgatactttgttctttgatgcttgagagattgtatttgcaggtaatacttttatctaaaaattaagatgaattttctggtttcagagtattattttgttaatgtctgctgttgcccttcacctctctgaaccctactgatttttctagatcaagctaaagaatgtcaagcttgatgaagttttcttctatctcaatagcttaaattatggcatttggacatggtttatagtatctatttcctttttccttgtattagttagctgtgtaatagttatgcctgcctcttatactggctcctagagagcaatgactgtgttttaggcatccttgtagcacctttcacagtacatatcccctatattttcaggaagtatttatgaaaaccattggtttttatcccggattttccaaattagacttacaaataagtcagtaatttgaggtttaaatgagtaattacacagttagccataatggttaaggctctatagttaagattgcccaggtttgagtgcctgcttcattatgtatcaactgtgagactccctcatctgtaaataggaatgttagtatcagcctcctagaattgttgatgaagactaacataattagtttgtttaaaacatttattgagatagcaaacatataggatacactcaatataatgtagtagtagtataatataacttttgctaaatgtagtcctattgggctggcctgtgagccccttgaaggcctgtcttttggtctttatatctcaggcacctaacctagcagacagtcaatactcaataaatacttgcttgaattgaattgatttatttaccctatttttatcttccattacagcccactgtttgtaacatggaagattggtcgagacaaaagattacgtggatgcataggtactttttctgccatgaatttgcattcaggactcagggagtacacacttaccaggtgaagaccaatttttgttacctctgcttttacattaaaaaaaaaaacttatgaaacttgaatctgatactttaactccttttactgaattgtcaacgttcttgtcttccttcatgtcaggtttttcctttgtctttaaccatttaccttttctctggtaaaatgttattgatatatattaccataatataaaatactgtgattaatgtattctgccatcgatgttttgaagtgttttttttttcttccagtggccagcttattttgtataacttgaaaaccaatgaccaaatgtccacgggttaccaaaatatgtgatttctatagtaacagtcattatttcttccctcttgtgttttttaaaaatagttgttgtctctttcatcttacacattttgttacacttttaaggacttttgaaattgaaaggagagcctaggaagaaagtgatgccacagcctagcagtataatcattcacattcacacttcacccagaattaattgtagcttgcttattttcttttatctaataaaaggacaaagtaattcctcattacagttgtttaaaactttgttcttaatttctgaattcacaaaaagctatctagcacacaatgtgaattttttggttcaagtttagatttcaagcaaattgtgacccaaaattatttcaaaagaagaaaattccttaaataataagctattagtaaaggaatttcctgtttttgttcacattttagggtgattatctgatacagtttctatagttgtaatatgcacagtgtctgtccaacaagaaattgctccctgctgactattggtacttggggcatgtttctcaacctccataggtaaaatagtaattacagtattttgttctatatacttaatagaggtgttaggagaatgaagtaataatcactattttacttcaggattaatgtggaacattattttactgtagaactgcataaatgcaggctcatagcaccagttaataaaatactgtaactgagtttggtattctcatatttgaaggtatgcagtagctcacagctgcagggttttctcagcttacagtgaagcccagaaaaaaaaccaatggcttgggggatcatattcattttttagcttttcacaggtataagaaactgggtgtttggatttgattaaataacatacaggctgtaagggttgaaacacatattctggaaataaattcaacttgttaaagataatataagtactagtctaggcatgttagattttttttttctgacataaaatacaatgggctcatttttgggacttcagcaaattctgccaatggctacctttttgggacaggtacatattaaattacacatttaatactaatcaatggcaatttattgtacatttcccaaaataagttgttatgaggaacactggttcctttgcgctacctgaagaaaagaattctgtgaccaaataagtttgggaaacactggttaaaaaatgtaaacaactctgctcactgtaggacttctcagaaccttttatgttaatagtgttatgtatatctaagagagagaaatagaatgtagcattttccaggcttatttgactacaggacccttttatcctcccaccccaaagtctgagtgttccaaggaaaacatttttggaaacacaagtctgttttcaaaacagaatattactttatatttgggtagtaagagttggtattatagaaaccctttgtgctttctagtgaaattgtagcagaaatcccattatcaaacattatataccttagaaatctttcgtagtggtcattgtggtagcaattgggttttgtttaaagaaaaaaataaattcttttgccaatgttggcaaggggtgaaaacatccaacttttctggacttgtccatttatatcctagggtaatgaccagaagaattacagtataattttctgacaataatgtgattctgaatgaattgttcaaatacttgaagttggaaatttgcctacatttgtataccttgttaccctcattgcaatctatagctcttcctgtttacttttcatcttttttctcatgtttctatacagcttcctcaaattgtatatatcacattaaagaggcgtgtgtgtgtgcgtgtgtatacatatgtttgtgtgtgtatacacacatgcacatacctggttttacttctcatttttgtttggcttaatttcttttgtataacaagatattaacaatcatactatttggaaaagatgaacaaaagaaaacaagtcttacaaaatacaattaatcttttttcctggattcattttagcatcaaaagttgtaaggagtcatttttaaaagttggaatataatatttttctgttcagtagtgtgcttatcatttttacgtattatgttattatgattatttttgttaatggctgccatttattaagaatttactatgtcagacattgttgaggagctttacatgcatagtccttgtaataacccttaggtactaatatctacattttcaaaatgaggaaactgagaattaggtaatttaaataatttacccactcacacatctattaagtgatagaaccaggattcaaacccagagcatgtgtctacaaaatccatcccctaaccgaggcaaaattttctgattatttatgttttgcagctttgtcatgaaaataatgaacttgaaagcaagttactataaattttataaatcatagatcagtaatccttcaaaaattctagttaggagttaagactgaaattttgcaacaggaaaatccatagatattattatggaaagtatacaactcagagttgtatagagcagacagaagaaaattgacttgaactaatattgtattaaggataaagcttattacaaaacaatactactgtaggataggaaattgtattctttggctacatggactagactttaagaatacaattttttttgaacataaaaattggtgattcttggcttctggtcatcccaccttaaaaacccataactcacaaaatgaataaatagaattaaatgaacttaggggataggggcataaaggagggagaaagcaaaacaaaaaacaaaataaaacaaaacaaaaaataagcagtgaaattaaaggcattctaggtataggcatctttttaaaaattcaaatatccggttcatctgtgattagatagactattgtttgattttcagaatgttactcaattatatctcttctttttttttattgtggggaaatatatgtaacataaaatttaccattttaaccatttttaaatgtatagtcctgtggccttaagcgcaatcatgttgttgtacagtcatcaccaccatccatctccagaacgtttttcatcttccccaactgaaactctacccattaaacatgaactccacattcttcctcctccaggccctggcaaccaccattctactttgcgttgctatgaatttgactactctaggtacctcgtatcagtggaatcatatgatatttgtcattttgtgactagcttatttcacttagcataatgtcttcaaggttcatccatgtggtagcgtgtgtcaatttaccttctttttaaggcagaatatattccattgtatgtatataccacattctgtttatcctttcatccattggtggacgtttgggtgggtggcttctaccttttggctgttgtgaataatgctgcgatgaacataggtgcacaaaatatctgtttgagtaccctttttcctcttaaaagtgaaccagtttatagaagacaatgatctagcttgtgtgtagtcccttaactctaaaacctttcttaaaaatatgaccagatattttttaaaatgaaatgcctatcctgaattaagtttttatttataaataaaattataaacttttaattttaataaaattatttaaacttttagaattaaagtacttgtcatagtcaagttgtatgttcaaatatgaccgggtattttttaaatgaaatgcctatcctgaattaagttttttaaatatatatataaacataatcttttaaatgtaaagtacttgtcaaagtcaagtcatatgttctcctaattgaaattttgattttagattgaaataaaatcttataaagaggctgaggatttcttctcaattgtgaaaatacatagtatttgtgtaggtaatgaaaagtttatgagaagtacatggaactattataaatagactattctttgtctgaccttgaaggatctgggtaaaagcaggaaagattatagaaaatacgaagcaggatggagagctcagaattattgataaaagtctatccatagaatttggtgataaagtccacaaattaccctatttatcattgctcaagacttcaaagtagaaatattctttgtccgagctgaaggagataatttccagtattgtgtttatggcttttatatattagaaagcagaggcagattcatttccccaattttagtacttagaaaacatacttttatagagaggaaaattaccactaatatagatgaatataaacatctcagtcaaaaaagattcctggccgggcgcggtggctcacgcctgtaatcccagtaatcccaggccagcggatcacgaggtcaggagatcgagaccatcctggctaacacggtgaaactccgtctctactaaaaatacaaaaaattagccgggcgtggtggcgggtgcctgtagtcccagctactcgggaggctgaggcaggagaatggcatgaacccgggaggcagagcttgcagtgagccaagattgcgccactgcactccagcctgggtgacagagcgagactccatctcttaaaaaaaaaaaaaaaagaaaaagaaagtttccttaaaattttggctaataaatttcccagcaaaatgcagatctatttctttatgtaaattcaagttggcagtaatttttctagaacacattaagtaattaatagatgtattcttattcagcaaaacaggattgtggtctgtcaccacacttaaaagactatctttttttctcctttgttgtacttagacctctcggcagtgaaataattatgcaggtgctggcagttctagaacttgattgtgaactatgccacttttgttgaactacttaattctaagaaattagcaatgaaagtttagccctttctagggaacagtatgaccacataaaaggtgatgtgctgtgttttgttttggagttttattttgttctgtgtgggttagtggggttgtgtgtcaggggagtttgaggggggattgattgcttgcatggtacaaatattcactttccattagattttttgagatactgaaaatagctaacaaacctactttattactttcaaaggtcctagctagattgggtacttatgggattcattgtaaactgaatttgcttttatattttggtgttgtaatctggcatttttctaaagcagtatgagtttaaagccattataagcagcataatattttccctgtcatagtagaccatcgtgtgatcatttttattcttgattatttgggtaaccactctaggctcattgtgaacacttagattaaacaagttcctcctccctctcatttaatattagtctttatggtagcatcacccagattgatttttcttatgaaaagaaaagctgtatgaatcacctctgactgtacattattgttatggaagctcattctggagatgttaaggccaaacaatttttggcaagtggttgtggcaagacttctggctaaagtatgcattttggggaaataaattagatgtatcacaaacaatgcaaaattaattagtttaatttacaacctacattttttgcctttttataaaagagatgatggcctgagtcctaaaacttatacctaatttgatagtttcagtttattaattacaaaatgagaaacatttgtcagattttataggcacttaatttaaggtacagtttggaacctaggttgttgtacgctctttactcaaaattatccacatgaagcatggtgaactatctgctcaaactggaatcctcattttagccatgaggttaatgcactccttcgttatcccaaggttgtgctaatgtgcagagatgtagccacaaaattcccagcagaatgtggaaactaagcagcaggaaccatttgcagaatgggtaatggctcctgaattgtagagaattgtctgaattcatatagcacctactgccacagaaattaagtgtagtgagtatatcagattctaattccttatcacatcatttagatctttagagtttccagttggaatctccctgctgctttgattaagagccacaggcaaaatgcctggggcagaaaaggccatctgtgaaaaggtagtgttgagagaagctgaaaatgggctttttcagcaccagggctcttggttcttaagtttgatagggagagagtgaactataagaaatttaccctatttttacatctatctgtaaagtttaatacctctctggtccttcgaggctgtttccccttttaatcatgtttaaacagttcatcctgcaaatcttgtcttaattttgccttaggagtttatgatatattaggagagataagaagttatcgaaataattgtagtcctaggtagaaagcagtttttctcaagaagcagaggacgtgatactggatgattactactctatatctgttataaaagctaaaatgtatttaaaggtatctataaattattttatttggttcatccctagttcactttttataaaagcaaaacagtatgtaccactttctggcttgtttttatcctacatggtccaaaaaggtcaaaattatagggatgcgtgtaaatcattattatcaaagcaaccatatacaaggtgttgggtatttatattttaagaaatttgtaatacatattttaaaggggaaaatgatcttgtcatagaagaaaaagcctttgaaatagaggactcttaagagtgtgcatgcacatgcacacatacacagggagtttaccaaacattagctagaaccaagttggattatagctctgatgcttggcaaatgaagaaaattaaaagttatagtttagatttcactttcctcttgtcttgttaaagtgaattcatattttgttttagtacagtaaactgatatctgtctcctttcctgagagtcattgtctgcgatagtcttcattttttcagatgaatgactgaaatggtaaagctaagttagaacacaaatattgtatgaaattattacattggatgtggcctaaaattatactatagacattaaaaatatatttcttttgtctgaatatttacataataaatgttgggcttacttataagtgtctaaagtatttgagtcattaggacctgaatgaacaggaggacagatttgtatcttagtgttctggaagaataagatggttatgctttgatgtaactaaaggtgattatcatgcaaatcctatgcttttaccacttttaaggggacaatgttaggaatttgagtactttaaaataattgaaagttgaggttttggtgtagcaattgaatattaaaattttagttatgatcttatgagcatgagaaatactttttaaaagtagaaggcaaaagaaatgaagcccttctctgtgatctttcccattctctcaaacttcaaactgccttaaatgtggttatccaaagtagtagtccttggaaaaaacttacttttcatcattgataacaatttgttgatctttaaatgctaaacacttattgcatcgtaagtcctttatcttgcatcataaatatatttttcttagaaacaactctagtttttcttacattctctctcaatttttaaataaagagcaaactttcaacataaaagtcctgtcctaaagaactacattatctgatctacttcttgttaacaaaagaaataaatatatctatatttatataacaaaatagacatggacaaattgtaacatttaaaaaattttctattggaatagaatatcatagatgctaggaaattctaaagatggaaaacaatatagtcatgtaccgcataatgacgttttggtcaacagtggactgcatatacaacagtggtcccataagattataatactttaattttactctatcatttctatgtttagatgcacaaatacttaacgattgtgttacagttgcctacattatgcagtatagtaacatgctgtacagctttgtagcctaggagcaataggctatatcatatagcctaggtacgttgtagactataccatctatgtttgtgtaaatacactctatgacgttcacacaacaatgaaattgtttaatgatgcatttctcagaatgaatccccaccattaagcaatacctgactgtatttaatacattcttttgagaatgaagctctaattattgttaatatcaaatatgcagtgtacttttcagtatatttaaaatctgaaagtgaagaaaatacatttggattcataaggtacagatttacacttggtgtgatgttcagaaaactcatttttgttaattttacttcagctcaaaaaattatcctgtaaatctacatatggaaactatagacttattcagattagattagcatgttattgtctccatttttaacactctgttttttttatttctacatggaaatgctaacttttgtatccttcctagtagtgaaagagaaagttagaaaaggccataaaataaattcttcagaagctttaattaaagggattgcccagaactcaacttcttgttgctatacccaactaccttcaggactactttgtatgttctacaaagctgatttaaaaggttccaactgcagtcacttcactgaggatggcaggaaagagaatctcttaagttctgcaggctgcttttaacctaaaccattcttctaagatgaccattacttgcctcctagctaagcctggagaagtattttaagcctttgaaatgagtggagctgtgttgcatatgaagaacagtaaacaactgtacactgctggttagacttgtactgctaatgagatcatgggttcaatccctatttggaccatatttttagacaatagctaccactagatcccaggcgttgattacagtggggctcagacagagcacgtgggcgaatcagtaccaaacccaagttttagcatcatttcagcatatgaaacgtgctacattaaaagtacccaaaacaatgtggtcttaaaatgtgatatacacaaaccctttgaaagtagcaagacagacatgccctttttctaaaattgacaaatcccgaagaggaagaaaagagttgggacaataaaacactggttctggaatctggaatgttgctttaagtccaggccagcagtgacaaaagttattgtaatgacctctgaacagacagacactgccattgagcaggcctctggtatagaaaacatggtacatttgggagttgtgaatatagctccaggtgtgctcctaaatcagttcacagtagattatgcttaacaacattgagatgttattggaggtgtggatgaggaagtttgttgttgcagtccttttttgcaccttattttaaagaataaatgaaacatttttctaattcccttttaaaaaattttaaatggaagggaagtttacttctgatgcttcagtgttgtaagttcaacatatagactgtcaacctaaattcatggtataacacagttcttttcttttttctttctttttttttgtatctgttcaatgaaaataaggtacaacccaggtttttacatagtctgactagaagtattccacttcaagatctgagagtagcattttctcaaactttcaccttaaaaaacaacatcactaaacaaaaactatcacacagaatggataagaagttttgtagatctttttggtgatgaactatgacatgagccttatagattgtaaaatatagttgaaactaatgtacataatgaaaatttttaaattttatttgctgttaaattctgtgaaatttcagttatttaaaataaacatgcaaaaatatgaaatgtaatgtttcagattgcaaggtaatatgtaatatgtttgtaagatactctggtctaatactaactagtagtatttggatttgtacagtcataattcattaaaatgacttcattttaacatgtaccgatgtagactaatattgtaagttctgatttaaagaatggtgacaaaatggcgcatgtaatacttttgcaagtgttggggaggtcggtatgttttgaaaagagtaatttaacttttgggtgctaggaaatgggttatctcaaagaccattgctggcaatgggcaggcctggtaatactggcacagagcattaatcatacaccttattaacggtgaggtgaataactttgaaataaagttttagggaagaaaagagactacccaaaacttagctatctcatgaacagttgatactaattataataataattgctttgaatctaaaagaaaaaagaatatttttagatgttaatttttcttcacaaactctttgaagagtgtcaatgtgacattagagaaaaggtctttggagtggcagtagaactgacaacacaggttggacttcagcaggcctgaaaatggtatggccaaaaggggagatttctttctgcctctaataaagagtagtggctaggaataggagtcatctcagatgatactggatttcagctgaagcaactcttaaatatttcagtggtaaaaggatgactatgttaaattcatgggtttgtaaatacatgttataaaatgtaattgttctttttaaaagcacatatttttttaaaagcctacattttaaagttgtcatctattgtgtattgagatgttcctgtgcctcacagatcagctcactaaggtgtggtagctattgtctaaaaatatgtaccctctcatactgttgcagcttcctcttcataggctttattattgcccagagcagcacatttaccccattagccaaaatggcacaaacaacgcccattggcatgactgaactctccttagttggtgtcaatccttatatctgagataagaagctttcctgtgtctacctttctcacctagagtaaaagccaaagtatttaaaaaacatatatttcactcagagtaaagttaatgttctgcaatgaatgccaccatgctcagcttgcccctctcacctcatctcctactcccctcttcccacctccattcattctcttggccttagctaggctggtttccttgtttccctttgaacacaccaagcatggtccccgccaggggctttgcacttgaattttctttacttgcaacagtcttctactagatagacatgtagcttggcttcctcacgcccttcaggtctctattcaaatgatgccattatcattgacacgtatgtaaaatagcaaggcctacatttgatatctggctctccctgcccgtttaccctgcttcatttttctccgtagcacttatcaccacctggcatactgtaaatttacttgtatatttgtgagtctttcttaatgcgaatgtaaattccatgagggcaaggactgctgtaatattcctcaaagcctacaacagtacgtggtacatagtaggcattcagaaaatattagttgaataaataaaagtcttgtttttatcagcatttagaaattgtggattataaagtataattctttgtcttactactttacctagatgtgaaattatttggtcttattgtggctagtttcttatagttttcattgagtgcatattgaatgtattttttgtgtgtgtgagtggtttgacattaaaattctcttttaaaactcattttatcatgaacacttttaaatactcgcaaaaatagactattataatgatgcagtcatttttataatagtgattttttttctcttttctttttgtggggaacagcgtctcactatgttacccaggctagtcatgaactcctgggctcaaacaatcctccagcctctgcttccctaagtgttgggattacaggtgtgagccaccatacctggctgctttttcattttacttatttttattttaatacttgctttttaagtacagaggcagtatgaggttgtagaaagaggtagccatatctgggttctagttgtgaatccctcaattcttagctttgtgacccaagggaagctactgaatttctgccatgtcttggttttctcatctgtaaaatgggtataattctaaactggtaagtttgttgtgaggattaggatatatatgtatatgaagtatcttatacatactaggtacgtagtaaatatttatattgtagtacatgcatagtaaatatttatatttctgcttcaggaagaaattaagtagtgagaatggccaagaaatgaaattttaaatatatttatagcaatttcagtttttctttttctcttggacacatgtaggtaggcaggaattttcataatatgagaagaaacaagcattatcagtaaataaaccagtgaccccataatcagtcaccatcacatttctgtttatgtaattctttaaaaaatacacacatacatgtaactgatcattgagcaaaacgctatcagtctatatttcctgttggttctgccccacagatatctcttgaatccaccccatcctcttcagcctcactgccactgcctttgtctgggttcttattctggctcactggtttccctgcttccctttgaagccattgtacaccaatcaccagaattatctttgttgacaaaaatctatctcactctccttaaaacagtgcctgttattccttatcaccagagaggaaaacccatttttattaagaagcatagtacttgaggacctaacctcacactccagccatgcacacaattattcaccacttcccaaatatattctttcatgtctctctggcttcacatttttttctttgcctctccccatttccacccagtcaactcctacttatccttcaagactcagcttgctcattgcttcctctgtgagatttccttgacagtccccaggaaaattggtcagtctcttttaggcctctattataacacttaacacactggattataattattaattttatgtttgtctctcccttttgaaattgcgctccacagtagtttaccaagcaacatcaaagcaaactaacaaaaaccagtctcattgctttgtagcaactttgcttgatcctgataaccattctactctctttcttttctgtttgcatatgttagcttatatctgtcacctcttcttgctgccagcatacttgagccagtaagagttaccagtgttgattgatagtgcaaagggtggcttaaggccacttggaattagactgagccagaggacagggatctttatacagaacactttagaaaacaaattgacatgaggttgatctcattataagtgactgaagatgcactatgtgaattgattcctgccatggaaccatagacctagaagagattcttttaagtcatctagtccaacccctatcagatactttaatctctcttaaaaatctcctgagtaatgggcatctagcttctatctgaacatctctgtagacttggaagtcacttccagttaagtagcccatttcatttcaaacacctctgaactctactcccataacttcagttaccacatagttttagtcgaagtgctagaagtcaaagattgcctgcaattagcactttattctttatagaaagctgcattaaccagcagtggttaaacttaaccctccgagtaatatctgaattatctgagtctttaggagtttaggagtagtaagataacacagctttacaattgagtctcatccacccacccatacaaattttaactcttcccttattgttgaaacctttgaagctactgctgccacaatatctctcacagtctaccttagacttctggagttggctgaaccctagagcccagagattccaagatagacctggtgctagatcttttagtgatcccaacaatgtcacagagttggaactagagttagaacacaggtctcctgacattgccttggactatcattacaaattccagaatagaaagtacccatattatatgtgacttgatgcttaaaaaatgaaaaagtacccataaaagtatatgaatttgttaattttagttaagaagcatacaatttcaaggaaccctgtaatgaaatgatcattttgtaatgtaaagatttattcttgagttatctgccttgtgtcaagtttaggcatacttccataaaatgaacaatacccttagaactattcaactgcaggagtaacaatatcagagttagagaatctcaaagcaaaaccttagatttcccctttcctttcctttccctttccgtttccctctcccctttcccctttcctttcctttctttccgagtctcgctctgtcaccaggctggagtgcagtggcatgatctcagctcactgcaacctctgcctcccaggttcaagcgattcttccgcctcagcctcccaagtagctgggactgcaggcatgcgccaccatgcccagctaatttttgtattttcagtggagacggggtttcacaatgttggccaggatagtctcgatctcttgacctcgtgatctgcccaccttggcctcccaaagtgctgggattacaggtgtgagccaccgcacccagccagatttcccttttctttaaacatatctctgcttgttatgtgtcccaatcatacttgtaacttctgttttgtgtgtgtgtgctggaactctcgtaggtattttatataagttacctcatctaatatttccaacaaccttatgaaggtgaaagtatttcacttatattgcagttagggaaaacaaggtcttagatggttaagtaatttgctgaatgacagctaataataacctgattctatctaattccaaagcctgtgctcccaaccactgtgcgatactgcttccttccagtaatatcactcccccttccctggtgaaagcttcttatggacatttgtttcactgactcaacaggtattccctggtgtccacttacagaaaaaaaaaaaatcactgaataacctttctcttcatttgggaactcagtttcttaactcagttttccaaaatctcccttatacccctagtccattaattccagtctcaacttctcttgggttctctttccttttagaatcttgaggcactgtctcccttaatatgacttttttcttcacagctatcctcccagttcagtttggtattctgaacttccatagtcccatcagaatttaccaccttctcagggatacatactccccaaactgatttctttctacatttgatcttagccaaaaggccaagaagtgattgatctctttctgtacaacatttgcacttaatatcagtacatttacatggaatactagtttagcccttagattctagccagacacaactctctgaaatccactgctgactagagagcctcgggggaaggattcaccataaaggaactgtgaataaaagtcctgactcagctattctcttcaactggccaaaaggtagacatttaggagttaagaagtgagacagttccttagaaattataattaaggaaacaaattccaagtttctaagtaattaagaccaaatatattgtcttagttttaatttttgcaatttgaagttccttaggagcagtttttgatagaacaaatgatcataaaacagttagataagtggcagacaaatatatccgtgactggtatcaggaaggaattgaaagtatgtagtcgtggactgtgtccatcttattgaacttagatttcttacaatagtaaggtttaaaaaaacaataaaattctccagattgtatttttttcttttcttttcttttcttttctttttttttgagacaggatctcgctctgtcacccaagatggagtacagtagtgcaatcacagctcattgcagcctcaacctcccaggctcaaggaattctctcacctcagccacccatgtggctggtactacaggtgcataccactatacccagcaaaatttttataatttttgtagagacagggtttcgccatgttgcccaggctggtctcaaactctaggctcaagtgatctgcccacctcagcctcaaaaagtgctgggatttcaggtgtgagccaccacggccagcctcagattgtgtctttttcttaccacagctgggatttgaggatctcagtatttaaaaggcaaagaagatttttagaatgtgctttctgtagtatacaagtattttatgatgcattcttttaaaattctgtggcaaacaatagtgaaaactttagaatcataggcatcattcattatcttctattttgctcctgaaccatttaaaaacttttctttgtctgaaacaagtattattggaaacctgttatcaggataggtatttttaaatttgacagtgaaaatatctttcaaacttgttttcatatactgcctgttaataataatgaaattaatgaattaatagccaggttggttgggacattgtccatgtcacacgtgtttctttctttcgtttttgtttgtttttttttttttgagacagggtttcactcctgttgcctaggctggagtgcagtggtgccctctgggcgcactgcaacctgtgcctccagggctcgagtgattctcctacctcagccacccaagtagctgggattacaggtgcaagccaccatgcctggctaatttttgtattttttgtagagacggggtttcaccatgttgtccaggctggtcttcaactcctgggttcaagtgatctgcccacctcggcctcccaacgtgttgggattacaggtgtaagccaccacacatggccaatttttgtattttttgtagagacggggtttcaccatgttgcccaaggtggtctcaatcacctaggctcaagctatccacctggcttggcctcctaaagtgctgggattacaggagtgagctatcatgcgcagtgctgggattacaggagtgagctatcatgcgcagcccatgtcacgtgtttcctaataggttttcaaagaattttgccacagtaagaagtttttatttcacatattcaagtcccacatacctgatcatggcaaaatggcaaattaatgatgtagttgaagagaaaccagcaaagagctgtagatgctagctcagaaatgagtaacatttttagtctttgggatgtcagtgatggtgcacagtgtatttaagtgtcatttttgtcataagccagagaagcaggaggaaagagtaatgggacatggtaaagcagaaattctgctaagtagctgaatgttagagttgattgctgctattctgtttcttgcctatagtgtagcccattttaagttcaagactaagaaaaccctccaaaaagtttaaaaaattcaaagcaaataaactagtaaatgctcatggctctacacttttacactgcagatttcttctatttcccaaaggactcacccagtgatgtttcctaactccccagagttactgtttcttcccttgtatgttcataacacattactggtatctctgttacagcacttgctttatcttgccttccaatgtagtttcttacatgattgtctttcctacttagattggtagtcccttgaggacctgaactatatttttcacatctttgcatcccctaagtagctatgagggattaggcatagagcaaaataaatgtttgaataggagagtcatttcccctagtatactgaggtatttgtttactagctgggtaagataattaaagaaagtgttaggagccacagcctatgcaaaggaagtgagaaatgaagattaaagcatctctgaaagtataagtcataggaaaataaaattaatttgcaaaggtgatttacttttatttttaggaatggtgagatgtatctgcattttgttttctatttatagttttaaatcaaggaaatttttactcacttgttttataactggatcagttttcatttaataaaggataggaacactcaattcttatgggatatttagatattctaatcacacctattaagttgtgctattataaaaatgaaacagttgaaatacaagtttaagatgtgctcccatggaagaatctatatgtactaattgtacaaatgagatgagaaacagaaatagcctggggaaaagaaatggggatgctatttaacatcctatatattacttctagcagacaattgcaatttacaatcactttataagaagaggtgccatgagggctgcttattaaaattgttttatgaaggacattttattcacagtagcactactgtccatatattatttttaaatccctacgagagagatggtcatttttgtgaagtttcggttgtagttcctggtcctacaaaggtttagtgagtgagtgatggcttgtcagaaatgatctttctgtgatggctgaaaactttgggaggaccaaagtttcaggtgagcaatcctaggtcatagcttcacatcctgccatttattatctagttaattatgcttgattctgcttgatacaaaaataaaatttgcattcaacaaacaaaacagtacctcacctctttttcacaaagaagaagatttgggctagagattgggagattttgtatttagcaaatttttaaaagtccttttgagatgtgtcttctaagggcttttgtttgctatcattaactgtgggaatatttgctcctgaatggatcccaccttatgctgagcccagcttcccttgtcattccccctgcaataaatactatacaataagtgtctatgtaacaaataaacagtttggaggttaaatggaatgctcaatataataaagctccattgcagtagggagaaaagtccttttgatatgcatttgataggaatgtgttaatttcaacaaaacatctggtataaaagagttgtgaatgcaggacatttgagggggttacagaaggagaagggatttactgtgcttaacaattgccagtagtcaggccacttccaagttgtgattttgtcagacttagaaattaagtgggatcacatctactcagcccttcagtgggagaagatccaaatccagctgcagcaaggagcagtgactgattcagaagtagtgagctctatccagtgtctcctagctggttttcattaatatgcttactattgccctctttatattctggctttttaaaaaaatatggcctttgtggtttattggttgaacttgtacagctgaatctactgtaaaaggtcttttttcactggcattatgtcctacagatttgagtgttcttgctgttctatataagataattcaaacttagaatagtcactatagtttcaaagcttgattgaaagatacattcagtgttttctctaaatatgtagcaattataacaacacagctgtagttaaatacataacttattataaatcctgacagtcttccttctcatttatatcaggctgacataaggtttagtcagttcaattccacatttatcgagcacttaactctgaccatggtactgtactaggtactatgcagctacaaagatcaacagtacatgatgtctgtgctcaagagctgagtgatgtcttttgagggaaattggcatgtacacaaaataactgcattagatgtagaaacaatgctactggaagtgggagaaattagctctagttggatagattggggaaggttttactgactagctgacatgtaagccgaacctctatggacatatacgactcaatttcaacattcaaaagtggggatatggagaagatattcattatgcatccagaaaacttcctgagccaaatgtaaggagacagagaaatatatatgagaagagaaatatatacaagcagcccaagttacatccctgactattactattaccctgactcgggctgcttgtattaatatataggatggaatggaaaggatagagattagagaagcagttatgaagctaatcttaaatattccaaatgaaagatggtagaggcctgaattaggttagtaacaggagggatgtaaagaaacatataacagagacaaggtagtaattgaacaagatgagacttgtggaaagtaagctaaagggaagagttgaagatggcttcaaaggttccttcttagatgatggggcagggggaggatgataagatgaaaggtgataggcaacacaagacaagaagcacatttgacacattgtttgttaaagagtcatttttaatgtgaaagtaatttttaattaatcctagattatctttttctgaatttgaatgttgaagattttttaaaattaagaatttattgaaaattgtttgctttcaggatatggtagtgagagtgaaatagagtaatacattattatacattgtatcttattaaatattttatttaaaattaaaataaataaaatagttggaaaagacccttgatatcattattttctcttaggccatgccacaaagcaaagcttagaaaatacagctgaatcctcaaacttctttctaaccaaaaatacattttgtggataagaaatctataaagaaataaatgtttgtaaacattgggcggttgttatggaatttaaatatctgttcttattacctaagaatgtctgggtttcaaggctgaattaaaatagattccaggcatctttaaaggtaaacaacacatctgttgatttgtctagtacaatggaaactgactgaattttgattatgataaaaatcagcatcttccatctatttagcaatacttttgggtaatcttttctcctttggggaattttccagatgtttgggaatatgattccaatttacaagagttgtttttatattgtagctgagtgatgtcctaactatgaaactcttaggttggtgtaactgtatccaaagggtcctctgcaatgtgtgtaggaatgccctgtgacaccttggcttctttgacttgcccagactctcaaagctaggtggctggaaggtttcctggaggcagagtccagttctcattgtagtaatttacattaacaaaggaattaacatttccagctatcttctgggatcactcagttttgagcaacattcatataatgcagtgaaaatgaatagctagtaccacaaaacaatttagatggttcctttggtacagacgttgacttgtattttctgaaaggaagagaagctctgaaattcagtgaaaatgacagggcggttgctattgtacacattattagaaagaaccatttcaaataacaattgtaaacatgtattttaatgctaatatactgtaatagcctagcattgagtagtgaaacaatttcagacaagtgtccaaattgttttatgactacatttatttcttagtatttatttagaaaattagtagtcaatgcttagttttatcccagtatggattataacttgtataatattctatagaaaaatgttacctaactggaataactcagagctgcctccctctgccccagcagttggtttgtgccctatgtttgctgattaccttaaatatttgcccaagtcaagccataatttaaaaagcaaaattctcatttaaagagtcacaagcttagggtgtcaagttgtagatgagtttggacttgtgggccctcttgttcctcctgattaacactgatgatacagagatgacaaatatgattaacccagcatataaagagacataacatcttaaaagagaggagagatttttggtgactttcttggccaatactattttggagatttttttcccatacgaaacttactggctagcatttcacttttgttggaacattgacctatgattattttattcagtattcttgcataggcctttgaaaggatacctatcaattttattgtaccaaatgttcttaagaaaacacatttggtagttctgatattttgaaggtttctatagaaacaagaaatcttacagccattttttttatattgttgctctgatttacaattctgtatatgtaaaggaggagtcttatcacctcaaaccaagcaaaatttgtagagcaccgatgatgtgcaagttttgtgtcttacagtaagggaaacctgtacaaatccaggagcttacaatataattagagtagctaggctctctttgtgacaaggtaactaagactcctaggcagtgagccatgcttgcagagggagtggttgtggagagctggaagactgccctgtgctagtgaagtgagagccagtatagatgtgtgaggagtaacaacctccaggaatgcttcctttggacaatgatgctactttgttgggtttgcattagatatttatttcataatgattatatgtttagtacttaacttacaggtttccaaagaattttagctgttgttttggctttttattatgtttgttttttttgtgtgtcggtctataacctcaggggcataagccttttttcccttccccctattttacagctagatgtacccccaaggtatctacattaggtatttctcctaatgctatccctcccctaggcccccaccccccgacaggccctggtgtgtgatgttcccctctctgtgtccatgtgttctcattgttcaactcctacatgtgagtgagaacatgcagtgtttggttttctgttcctgtgttagtttgctgacaatgatggtttccagttttgggcgggtgtatgtgtccaggaatttatccatttcttctagattttctagtttacgtgcgtagaggtgtttatagtattttctgatgttagattgtatttctgtgagataagtggtgatctcccttttataattttttattgtgtctgtttgatccttctctcttttcttctttattagtctggctagcggtctatctactttgttaatcttttcaaaaaaacagctcctgaattcactgatttttttttgaagagtttttcatgtctctatctccttcagttctgctctgatcttagttatttcttatcttctgctagcttttgaatttgtttgctcttgcttctctagttcttttaattgtgatgttggggtgtcaattttagatctttcctgctttctcctgtgggcatttagcgctataaatttccctctaaacactgctttagctgtgtcccaaagattctggtacattgtgtctttgttctcattggtttccaagaacgtatttatttatttccaccttaatttcgttatttacccagtagtcattcaggagcaggttgttcagtttccatgtagttgtatggttttgagtgagtttcttaatcctgagttctaatttgactgcagtgtggttggagagactgtttgttatgatttctgctcttttgcatttgctgaggggtgttttacttccaattatgtggtcaattttagaataagtgctatgtggtgctgagaagaatgtatattctgttgatttggggtggagagttctgtagatgtctattaggttccgttggtccagagctgagctcaagtcctgaatatctctgttaattttctgtcttgttgatccaatattgacagtgaggtgttaaagtctcccactattattgtgtgggagtctaagtctctttgtaggtctctaaggacttgctttatgaatctcggtggtcctgtattgggtgcatatatatttaggatagttagctcttcttgttgcattgatccctttaccattatgtaatgcccttatttgtcttttttttttaatctttgttggtttaaagtctgttttatcagagactaggattgcaaaccctcccccccccgtttttgtttttttttttttgctttccatttgcttggtaaatattcctccatacctttatttgagcccatgtgtgtcttagcatgttagatgtgtctcgtgaatacagcacaccaatgattcttgactctttatccaatttgccagtctgtgtcttttaattggggcatttagcccatttacatttaaggttaatattgttatgtgtgagtttgatcctgtcattatgatgcaagctggttattttgcccgttagttgttgcagtttcttcatagtgtcaatgatctttacaatttggtatgtttttgtggtggctggtaccggtttttcctttccatatttagtgcttccttcaggagctcttgtaaggcaggcctggtggtgacaaaatctctcagcatttgcttgtctataaaggattttatttctcctttgcttatgaagcttagtttggctggatatgaaattctgcattgaaaaatcttttcttttagagtgttgaatgaatattggcccccactctcttctggcttgtggggtttctgccgagagatccactgttagtctgatgggcttccctttgtgggtaacccgacctttctctctggctgcccttaacattttttccttcatttcaaccttggtggatctgatgattatgtgtcttgggattcctcttctcgaggagtatctttgtggtggtctctgtatttcctgaatttgaatgttggcctgtcttgctaggttagggaagttctcctggataatatcctgaagagtgttctgcaacttggttccattctttctgtcactttcaggtacaccaatcaaatcaaaaaatatttggtcttttcatatagtcccatatttcttggaggctttgctcattccttttcattcttttttctctaatcttgtcttcatgctttacttcattaagttgttctttaatctctgatatcctttcttctacttgatgattcggctattgatacttgtgtatgcttcacgaagttctcatgctgtgtttttcagctccatcaggtcatttatgttcttctctaaactggttattctagttagcaattcctctaactttttttcaaggttcttagcttccttgcattgggttagaacatgctcctttatcttggaggagtttgttattacccaccttctgaagcctacttctgtcaatttatcaaattcattctctgttgttttgttcccttgttggcgaggagttgtgatcctttggaggagaagaggcgttctggtttttggaattttcagcctttttgcgctgttttttcctcttctttgtggatttatctagctttggtctttgatattggtgaccttcagatggggttttggtgtggacatcttttttgttgatgttgatgcttttcctttctgtttgttagttttccttttaacagtcaggcccctctgctgcaggtctggtggagtttgctggaggtccactccagaccctgtctgcctgggtatcaccagcagaggctgcagaacagcaaagattgctgcctgttccttcccctggaagcttcatcccagaggggcacccgccagatgccagctggagctctcctgtatgaggtgtctgtcgacccctgctgggaggtgtctcccagtcaggaggcacgggggtcagggacccacttgaggaggcagtctgtcccttagcagagctcgagcactgtgctgggagatccactgctctcttcagagctggcagcaggaacattcaagtctgctgaagctgtgcccacagccacccctttccccaggtgctctgtcccagggagataggatttttatctgaaagtccctgactggggctgctgcctttctttcagagatgccctgcccagagaggaggaatctagagaggcagtctggctacagaggctttgctgagctgcggtggcctccacccagttcgaacttcctggcggctttgtttacactgtgaggggaaaaccgcctactcggcttgagctatatttctgattcagttattagtgactgtaagatttatacttagagatctttgagcatgacaaagactgtaggtgaggatctagcaacaccaacatggaagtaaaagctctcaaattcacaataattgcaggaagcccagtatactcaataaagaatgaatgaaatatttatttaaaaagtagttttgcttgttttagtgacaccgatttgcttgtgttagtgacaacaataactcagaatgggctaatggagtgttaccaagtagaagtcccccagagacctgctttttaacatactacacaaaagatttgtaattatgatgttacagtgcctgtagatggttaattccagaatcctggaaataatttattctctttaagcaagtcctgtatttcccttacaaccttaattataaagttgatttgcttagcagacccttcttttccaaacttgctaaggaaaactttcagtctaggtctgtttgaattagcacaaattttgaaatagtagagttcaaattaatgaggttttattctgttatgaagagcttgttttccatcattgataattatttccaggaaagttaagtctgcagaaagcattctctcagtttccttaatgttgtttaccaaagtttaagaagtggtttttagttacatgaggggagagtgaggacatggcagtggcaaaggaaaatgaggtgctataacctggtctctcagatttgtggagcaggctttgagcagcattctaaaccaatattattccttgtaaaaggcaaaccagaccttggaattttaaagtctaatgtgattgagagaatgtgtgctggtgcatagtaatactttaacccccatcagtcgggtaagttgtaagaacctcttaggtgacaaataccctgacagccccacgaggcatgcaccatttccacccattttccctagagtcagcccttctcccactagataattctcattgcttcagagggttgattttcaacaagtcctccatccccctagactgcttactaacctgaaatcccacagagaacaggaagagtggccactggatttttttggaggatttaaaaaaatttgtgtactaatatctgattttctttaggcccatgttcatctaaagagtccgttatcttatgtttcttttttctatgcctgcccttgatgtcctgtgattcatccagttcataagatgttcctttataagaaggtgagaaaagcataaaaatagactagtaatatgggtccctatgtgtttcaaactgcaataaaatattattattaattgccccatataagaagcaatggagctccttcaggatgcagagtttatgtgtgttttccaggggggtgatagaggctgggagatcaaagcaattctgtaactttatcatggaattatgtttttatctatttatagcagtctatgagttttagatagaaaaatgttgccaaactttgctgtactttgaatgtacagtaatctaaagactaaaaagaacagttaacaccttctaaatgaacagcattaaataaataaaaacaggggaagacacacttcagtggaacagtttaaaaggatattttgaatgtaggggaacactgaccatttaataaagtataaccagtaatgccatttaatatttgttatactgccaataactttattaaatttgaaactaccttcctatattccttcattcattcactaaatatttatttaccagctactgtgtgctaggcactgggtatataatggtgagtaaaaatgagcacagtcaccatactcatagagctaaagttatacctataacatatacatggggataaagagtccaaaagttagtttttaatttggatttctatagggttttgcttagcctggtagatttctagagataggctagtatccatgaactttaagaagtaataagaccttgtgagtttaggtgtcttcctcttttttttttctttttttgttttttatttctggaatgtgacttagtttataagacttgcacttctcattaggtgctttgagtaactcgtataatatggtattgtagtgtagtaaaacttcaatgaaacaaggtgttccacagcattgaaattgaatgtagcatgctcctggatgtatactcgtgcttggcacatagcaggcactcaatacatatttgttgaaatagttcatgttcatagttatgccctcatatcagtaatcattaggactgctacttattcgtgaaaagttttgtcactatggggagcagagctgttatcacatgactgtaatttaaattgcatagattttatccattgcccttttctcttttcttttttttttctagtcctaactgctagaaatattacccctgaaggtatttgttttcttttttttttattatactttaagttctagggtacgtctgcacaacgtgcaggtttgatacataggtatatatgtgccatgttggtttgctgcaccatcaactcatcatttgcattaggtatttctcgtaatgctatccctctgccagcccccaaccccacaacaggccctggtgtgtgatgtcccgcaccctgtgtccaagtgatctcattgttcaattcccatctatgagtaaaaacatgtggtgtttggtttcctgtccttgtgatagtttgctgagaatgatggtttccaacttcatccatgtccctgcaaaggacatgaactcatccctttttatggctgcatagtactccatggtgtatatgtgccacattttcttaatccagtctatcagtgatggacatttaggttggttccaagtctttgctattgtgaatagtgctgcaataaatatacttgtgcatgatttataatcctttgggtatatacccagtaatgggatggctgggtcaaatggtaattctagttctagatccttgaggaatctccacactgtcttccacaatggttgaaccaatttatactcccaccaacagtgtaaaagcattcctatttctccacatcgtctccagcatctgctgtttcctgactttttaatgattgccattctaactggtgtaagatggtatctcattgtggttttgatttgcatttctctgatgaccagtgatgataagcattttttcatgtgtctgttggctgcataaatgtcttcttttgagaagtgtctgttcatatcctttgcccacccttcgacagggtggtttttttcttgttaatttgtttaagttctttgtagattctggatattaattagccctttgtcagatgagtagattgcaaaaattttctcccattctgtaggttgcctgttcacgctgatgccagtttcttttgccatgcagaagctcgttagtttaattagatcccatttgtctattttggcttttgttgccattgcttttgatgttctagtcatgaagtccttgcccatgcctatgtcctgaatggtattgcataggttttcttctagggtttttatggtttcaggtctaacatttaagtctttaatccatcttgaattaatttttgtataaggtgtaaggaagggatccagtttcagctctctacatatggctagccagttttcccagcaccatttattaaatagggaatcctttccctatttcttgtttttgtcaggtttgtcaaagatcagatggttgtagatgtgtggcattatttctgagggctctgttgtgttccattggtctatatctctgttttggtaccagtaccatgctgttttggttactatagccttgcagtatagtttgaagtcaggaagtgtgatgcctccagctttgttcttttggcttaggattgtcttggcaatgcaggctcttttttggttccatatgaactttaaagtagtttttttccagttctgtgaagaaagtcattggtagcttgatggggatggcattgaatctataaattactttgggcagtatggccattttcacgatatcgattctttctatccatgagcatagaatattcttccatttgtttgtgtcctcttttatttcgttgagcagtggtttgtaattctccttgaagaggtccttcacatcccttctaagttggattcctaggtattttattctctttgtagcaattgtgaatgggagttcactcatgatttggctctctgtttgtctgttattggtatataggaatgcttgtgatttttgcacattgattttgtatcctgagactttgctgaagttgcttatcagcttaaggagattttgggctgagacagtggggttttctaaatatacaaccatgtcatctgcaaacagggacaatttgacttcttcttttcctaattgaatacctttatttctttctcttgcctgattgccctagccagaacttccaacactatgttgaataggagtggtgagagagtgcatccttgtcttctgccagttttcaaaggaatgcttccagtttttgcccattcattatgatattggctgtgggtttgtcataaatagctcttactattttgagatacgttccatcaatacctaatttattgagagtttttagcatgaagggttgttgagttttgtcgaaggccttttctgcatcttttgagataatcgtgttttttgtcattggttctgtttatgtaatggattacgtttattgatttgcatatgttgaaccagccttgcatctcagggatgaagccaacttggtcgtggtggataagctttttgatgtgctactggattcggtttgccagtattttattgaggatttttgcattgatgttcatcaaggatattggtctaaaattctcttttttgttgcgtctctgccaggctttggtatccggatgatgttgaccgcataagatgagttagggaggattccctctttttctattgattggcatagtttcagaaggattggtaccagctcctctttgtacgtctggtagaattcagctgtgaattcatctggtcctggactttttttggttggtaagctattaattattgcctcaatttcagagcctgttattggtctattcagacattcaaattcttcctggtttagtcttgggagagtgtgtgtgtccaggaatttatccatttcttctagattttctagttaatttgcatagaggtttttatagtattctctgatagtagtttgtatttctgtgggatcggtggtgatatccccttgatcatttcttcttgcgtctatttgattcttctctctcttcttattagtcttgctagcggtctatcagttttgttgatcttttcacaaaactagctcctggattcattgatttttttgaaggggtttttttgtgtgtctctctctctttcagttctgctctgatcttagttatttcttgccttttgttagcttttgaattggtttgctcttgcttctctagttcttttttttttttttttttttttttttttgagactgagtctggctctgtcacccaggctggagtgcaatggcgcgatctcagctcattgcaagctccgcctcccgggttcacgccattctcctgcctcagcctcccaagtagctgggactacaggcgcccaccaccatgcccggctaattttttgtatttttagtagagatggggtttcaccgtgttagccgggatggtctcgatctcctgaccttgtgatctgcccaccttggcctcccaaagtgctgggattacaggcatgagccacggtgcccagctagttcttttaattgtgatgttagggtgtcgattttagatctttcctgctttctcttgtgggcatttagtgctataaatttccctctacacactgctttaaatgtgtcccagagattccggtacgttgtgtctttgttctcattggtttcaaagaacatttttatttctgccttcatttagttatttacccagtagtcattcaggagcaagttgttcagtttccatgtacttatgtggtattgagtgagtttcttaatcctgagttctagtttgattgcactgtggtctgagagacagtttgttgtgatttctgttcttttacatttgctgaggagtgctttacttccaagtatgtggtcagttttagaataagtgtgatgtagtgctgagaagaatgtatattctgttgatttggggtggagagtcctgtagatgtctcttaggtctgcttgttgcagagtcaaattcaggtcctgggtatccttgttaaccttctgtctcgttgatctgtcaaatattgacaatggggtgttaaagtctcccattattattgtgtgggagtctaagtttctctgtgggtctctaaggacttcatttatgaatctgggtgctcctgtattgggtgcatatatatttaggatagttagctcttcttgttgcattgatccctttaccattatgtaatggccttttttgtctcttttgatctttgttggtttaaaatctgatttatcagagactaggattgcaacccctgcttttttttgctttctgtttgcttggtagatcttcctccatccctttattttgagcctgtatgcgtctttgcatatgagatgggtctcctgaatacagcacactgatgggtcttgactctttatccaacttgccagtctgtgtcttttaattggggtatttagcccatttacatttaaggttaatattgttatgtgtgaatttgaccctgtcattatgatgtttgctggttattttgcctgttaattgatgcagtttcttcttagcatcgatggtctttacaatttggcatgtttttgcagtggctggtaccagttgtttctttccacgtttagtgcttccttcaggagctcttgtaagacaggcctggtggtgacaaaatctgtcagcatttgcttatctgtaaaggattttatttctccttcacttatgaagtttagtttggctggatatgaaattctgggttgaaaattcttttctttaagaatgttgaatattggcccccactctcttctgtcttgtagcgtttcagctgagagatccgctgttccctttgtgggtaactggacctttctctctggctgcccttaacactttttgcttcatttcaaccttggtgaatctgacaattatgtgtcttggggttgctcttctcgaggagtatctttgtggcgttctctgtatttcctgaatttgaatgttggcctgccttgctaggttggggaagttctcctggataatatcctgaagcatattttccaacttggttccattctccccatcactttcaggtacaccaatcacacgtagatttggtcttttgacatagtcccatatttcttggaggctttgtttgtttcttacttttttatctctaaccttgtcttctcgctttacttcattaatttgatcttcaatcactgataccctttcttccacttgattgaatcggctcttgaagcttgagcatgtgtcacgaagttctcgtgccatggttttcagctccatcatgtcacttaaggtcttctctacactgtttattctagttagccatttgtctaatcttttttcaaggtttttagcttccttgcgatgagtttgaacatcctccttcagctcgtagaagtttgttgttaccgaccttctgaagcctacttctgtcaactcgtcaaagtcattctccgtcccactttgttccgttgctggtgaggagctgtgaccctttggaggagaagaggtgctctcatttttagaattttcagcttttctgctctggtttctccccatctttgtggttttatctatctttggtctttgatgttggtgacctgtagatgtggttttggtgtagatgacctttttgctgatgttgatgctattcctttctgtttgttagttttccttctaacagtcaggtccctcagcttcaggtctgttggagtttgctggagttccactccagaccctgtttgcctgggtatcaccagcggaggctacagaacagcaaatattgcagaacagcaaatattgctgcgtgatacttcctctggaagcttcgtcccagaggggcagctgcatatatgaggtatctgttggaccctactgggaggtgtctcccagttaggctacacgggggtcagggacccacttgaagaggcagtctgtctgttctcagatctcaaacgctgtgttgggagaaccactgctctcttcagagctgtcagacagggatgtttaagtctgcagaagttgtctgctgccttttcttcagctgtgccctgcccacagaggtggagtctagaggcagtaggcgttgttgagctgaggtgggctccgcccagttcgagcttcctggctgctttgtttacctactcaagcctcagcaatggcggatacccctcccccagccaggctgccgcctcgcagatgcatctcagactgctgtgctagcagtaagcaaggctccgtgggcgtgggagctgccgagccaggcacgggagagaatcaccttgtctgccggttgctaagaccttggtaaaagcatagtatttgggcagggagtgtcccgcttttccaggtagtctgtcacggcttcccttggctaggaaagggaaatcccccaacaccttgcgcttcccgggtgagtcaacgccccgccctgcttcagctcgccctccgtgggctgttcccactgtccaaccagtccgaatgagatgaaccaggtacctcagttggaaatgcagaaatcatccaccttctgcattggtcatgctgggagctgcagactggagctgttcctgttcggccatcttggcaactcccattgcccttttttcatcctcaaatgaagctatttcctttctgtatctattgtggtgttcctaatatgtagcatagtacagaatcagcaattgccactatttcagcagcacattttgaagcttttccaacatattttattaccccatgtgcttatctcatggaaacaaaagtaaagtaggaccttttcaatgggagaattaaataacttttaagggtaatagaatggaaacctatacaagtaaaatttttctttgaaaactaggttcttaagatatgaccagacaagagatgaagagttaaaatgtccttttctgttttatcaggctaattttaaaaatgtttgttgaaaggagtaaagtaaaacctgttccaagttgagattggaaagtaggtttgcttaacgtatgagactttagcagtacatcaagaatcacatatttgacctgaactgaatctacccatgtcattgtgctatttacttgaaaacgaatgttgagattatcttgccctgaacaattttgtagttatacacgcacaaccagaacatacagttgcttttacaatagggacagattctctatttagagtttgataaaagagaaccaaatactctattttaaaaatgtatagcctttcccttgaataatcctttatgtagctcagcagctaagtagaaatgatgggacagaatggatgaactgcgaggtgagaccagcccctactaggagcgtataagcaagatgaggagggagtggagtggataagaaacgcagaggaagacaatagttaagactgcattctccacacacacatagtgttggtgctccgctgctcccccacccttatctgcttaatttataagttctgcttggcttcatcatgctgacacgtgccaggtgcctgtcagtgctgagttatgttgggcagctcactgtttcactgttttagctattccctggtgccctaggcatcattttcctctttgcatcttgaacatctgctctggagtgttattggattatgtgaaagaatgatggaaagatcagtgaattggggaagtcaggagatgtcactgatttctaagtagttttgtgactttgggcatgcagctttttgctcttagttatccccaaaatcaaatgaaggatgtagactagatgatctctaagcgcttctagctgacatttgcttgaccccatgactttagggggccttgttcttggaggacacctattatgatttctaatataatgtagtattagctttgtctatttcatggggctgttttgagtttcagctaggataaaagatgtgaagatgctttggaaactattaagaatcatataaaacaaaaatgatacgagtagtttaaaagattctttcctccaaagataccatatagtgataaaaattaaagtaattccatttaaatgaatgtgaggccaattacagaggccataagaacagacatgcagttatacttaccatagagaaatatgccatttaaaagcacacagatcaaggaatgattcaataaacattgattgattggttaggcagctaggctttggggatgaggtattctacttttcttcctgatcccccttgtgcttgtcaagtttgaaagaaacaggcagtggatcatgttcttttctctgtcactatcacccatccactccacgaaagttagaatagaacattaaaacctgtacagaagggaatgggtcatcttgacccaatagcagagtatgagaacatgaggccgccttgcatactggcttgtcagacttggcctcgccagcactaggtagcagtgaaggcagctgccgtatgcctttgtctttgtggtcctcttctcttcctccacccccattctgttctttcatgtccttcttgtgaccttttactattctttcttccttaccttactagagtagaaaagaggagcgcatacaaaaggtggggaaaaggaagaagagaaaggaaaataaagattaaaaactttacaatgaggtagtggggaaggttgggctcctctctttctctttctccttctcagtatgacggacttgataattttactttgtacctcatctttaagtttgacttcattcttttctttagttacctttagtccccgatcagtgacatatgcagaaaattataaacaggccgcatgataggaaccagtatcctgcctctcagcagacttgtatcatctaggactggcagtagttttagaaaggacagctgaaccagcctgacatgacacataagttagagtgacaacacatgttttgcagtttatagagttcaattaatagatttgattgccatggaaagagggaaggaaaagaattgcatgactcgtgtactgagtatgagagagcttattcatacaggttggaaaagcaaaattaaaaaatcagaaacaggcccaccagcctagatatgtccaaaactagtactttggtaacctattatgacttccagcagattaagtttcaaactgtggaaagggcttcggaataagggaaggcttagcatcccactaataaggcttattaagtttagataaaacagatgtttttcaatggtagcagctctgagtcaccaagatcaaaatggagaaagaagagaacaaaaacaagctaacactttcattaaaaaggtactatttttcttaggcattttcagaacctgctcacatttatacttaatactttcagttaaatcctatgaacggaagcattaattggggaaaaattccttaatactgattaaatgtatatacatttatgttgatttgctgacattctgaaagtggtactatgaaaagagaatgggatttagaggcaggcggtcctaatttcatatgtcagctctcttacctgtttttgtttctttgtttttgtttttgttttgagatggagtctcactttgttgcctgggctggagtgcagtggcgcaatctcaactcactgcaacctccacctcctgggttcaagtgattctcctacctcagcctcctgagtagctgggattacaggcatccaccaccatgcccggctaattttttttgtatttttagtagagatggggttttaccatgttggtcaggctggtcttgaactcctgacctcgtgatccgcctgccttggcctcccaaagtgctgggattacaggcatgagccactgcgcccgaccagctctcttacctgtttttagaaccattggcaagttacttaatctcactgatcatcactgaacctcagcttcttcctctacaaaatggagttgttttgaggactaaacaacttaatgcatgtatagtaccttactcacagtaggtacttagcagatattggctttctgagattttaagctgcttttgctcatagtgccatgtctaaatatcttaggaccagtcttctagagcttgatgaggagctttaggccatccaaagagggatgcacctgaaggattcattgtggggtgagataaaaatattagaaagtctatttatatcattttagataaaatataagaaagtatttaaactccactaatgtttaacatgtggattgaccctgatgctctcctttggtccatgttggagagtcactgtcatatactctaaatgagggatcccgagaaaagtgtgagatttcttgatttggtgagagttcatggtggcatgcacattcttttgctcactttaggcatattgtaacatatttcagtttacatgtacctagttaagtagatttctagttcttagtacaggttgagcatcccaaatccagaaatctgaattgctccaaaatccaaaacttttgagtaccaatgtaacgcttaaaggaaatacttcagatctcagaattttggatttgggatgttcaaccagtataatgcagatattcccaaatcacaaaaaaatcccaagtttgaaacacttctagactccagcattttgaataagggatattccaacctatataatcttcatcctgtggtttctttgcaggaatcttcttaagctgtttgactattgtgtgtaggtcagttaaagctagataaactaacccacgcagaatggacaagtggcttaggaagattcctgcaaggaaaaaaatgggctgatgataacagtgataatgcaagggcaagaaaatggtgaactagctgacacttctatgagtttcctcttaatttagccaagtcatgaagtgaaaacaaaaataatctaatcaaatctgacaagatgtcagccccaaaacaagaaaggatcaagagcattatttaatttatactcactgtctttaataacaaagcctactctaagtatcatgctttgatatattagcctgtcatagtagtacaagtatatactttataaatatacatattgaggatgtgtgctcaaactttttttagtgataagaatactcaatcaaaactgtttggatcctggtgatgacagacgacattgtcagccaatccccatgtggtagtgaggacatgtcctgcagttctgaagggattctatggattttttttaatttaaaaaacgaaaaactaattttaaaaaaaaacagcttggagactgctattttaaatgaggaaagcagttgctgcctatggaatctctcatctctcattctgtatctgctgcttagaaatcatttttcttgtttttgttttgttttgttttgttttttacctaaggattttgctatagtatgaatagtaggatagagagtaatatatctaaatccatcaaacatgatttagggaactttatttctgataaacatttcttctacagaagtaaaagaacaattcctgcccaaaagatttaaaaactgtagttcaagaaaactaagaaactgtttcaaagcagcatatgaatccctgcctgcagtataatggaaactcttgatgaagatgtaccttacttgatgtagatttgtttctgaaaaatatatatatatcttttttttatttctgtaaaactccctgtaactctgagtcagttggtaaccagtaaaccagtagcatattgtaaaacagatcttttcaaaaagagcgctaacctgctctgattattcctctcagcagtcctatagcatgattttaacacgtattttatacatatccatatattatttagtaatctattcttatattctccatggctctttgcataataaaaagcaaatagtgggtgtttaatacttattttgaaaatgaaagaaaatgaaatgaaaacaccagaacctggaaaggtagtcattatcccccgagatggccacatttaattcctagagaagataacttgtttagttcttcccacagcacagcttagtcctgtggctccctttctttcaccagagccataatatggggcagccctgtggacagacggatgatcaatcagagttctttgacagccactacttattgagtaggttagtaaaggcacttgtgcagttattattattttatttgttacagttgctccattaggtgggtactgttatgatctccatttcataaatgaggaaatgaaggctggcatagattaagagacttgcccaaatgtcacacaactaatgtatagtggagccaggatccaaatgcaagtatatctgactccagaacccaagctgttggccattgtaatatgttatgttctagagaactgtgaaatagtgctcattaattaacgattacttcaattttgcattttaggagctatatttattggcataagtcacagagaactgttgttataccttggagacacacttttgatgggtctggggaagtaatactaatttgggattgtagaccaggtttctaaattccaattcagttcaagaggtggttcattcagttttatagtatatcctaacttaagagaacacacggatgagatccctggaaattttgccagtctgtgtgttacacagtctcttgaaggtagagacaatctcatatcttcacatttccaagcttataattgtcagtggtcatatcgtaatcttttccaaacccacacatttttttcttgccaaggcctcgagagcactgttgttatggtgtacagtaacaaatgacccagttatattgagttttaaagatgaaccagattcataaagagaaaattaaattatattcattttactttggcagattttcatcagaaaaacataatttaaacaaaaatagtttctagtagttcatttctaaaaacaagatagagtaaatctagaaactctgcagagaaagcattatgtagacattttgtagagggaaataagaaatactttctgtatatacaaacatttagccatctgtttctttatgtatcttttattttccagttttagctctgctccactaaatcaaattcagacccaattctcttaatttagaggggaggaatttgtggcctaggaggcagattctgatgatacttgctggtcctcacagctggcagctcacagggaattttcccttcctggtgggcagctatggctatctcatagagagtagaggcttttaagaatgcaagatcagagcatttcaggaactttaatcagagggcagtaagtgataacactctaaagcctaagtgaatctcataggatagaagcccgataatatatatcaaaacctactgaacctgttatcctttatctccctctcctctctcttacttttccattctccctttcttgctttctccttgtttctttgcatatgtctctatttgagccctttctaagtgtcccccttttttgtactttctttgactcctacttcttttttcagcttcttgcttttctcttcctttctctttttacatattcctttttcctttttctttcttttttttttttccagaattggataatatggtttttttttttaatttaagttttagggtacatgtgcacattgtgcaggttagttacatatgtatacatgtgccatgctggtgcactgcacccactaactcgtcatctagcattaggtatatctcccagtgctatccctcccccctcccccgaccccacaacagtccccagagtgtgatattccccttcctgtgtccatgtgatctcattgttcaattcccacctatgagtgagaatatgtggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccccgaggaatcgccacaccgacttccacaatggttgaactagtttacagtcccaccaacagtgtaaaagggttcctatttctccacatcctctccagcacctgttgtttcctgactttttaatgattgccattctaactggtgtgagatggtatctcattgtggttttgatttgcatttctctgatggccagtgatgatgagcattttttcatgttttttggctgcataaatgtcttcttttgagaagtgtctgttcatatcctttgcccactttttgatggggttgtttttttctttctttctctcctatcttctcttccttttgttccatcccttagttctttcctctattccccatgaattacccatcatatcatattaagcatatatattaaaattaataaatgttaatggtcattgagcagcaagaaggttttattattactgtaaaaggaaaaacatctcccagttaagtaacactgtacatatagcttacaattgaaacttttcttttgagtaacagccctcaccaaaataaggcacctttcctccttccttaaccataattgtgtcttttgttcttcctctctacccttaggtttgatgaataggcacatttttacattttgttttgtgtccattacttcgtgaattttagaaagctaaaattgctacttagtgagacagagcggtagataatttttcagatgtgggtttaggattctagtattctgagtttctggggttcaaacatgccatgtatgcattctattccagaagctctagcagggaatgacagaatatggaatttcctggtggttgaaacccctcatgaaaaaactgcttttagttttagactaaaacatagttgaattgcttctctttgcctgtccaaacagggatttttaatttgggttttaattacttccttgtcctgaataatagttatatgtaatatgaagcccctctcagtttgataactttccagcagttaaccgattaaggtcaacaatattttagaaagtgaatgaacaagtgagcaaatgactagacagagtcccttaaattatttctgttacatgctctatcgtttacgatgagccttgtaatatctaaggttttgcctcttttcagcgacttttttttctttttagcatagtttccaggcactgtcacaaactctttggttctttcatagctaaactcttaatatcttttcttaaaatgttcatttttattaaagtactatataacattatatattaactttgacaaatgttaacgttccttctcaattaggtgaggtgtattcttgagaaggtgccaatttgaattgaatatatttgaatttgatatgtgaactaaactgtaattgtttaaagcttacccatccatcatatgggtgatggagcagctgactgattttacatgtaagtgttttgttttgtttttctagcaatatttaaacattagaaaatgatttcctattctaacaaagagaaattcatatgaatttacttacaggacccccttgtcagttccttagactgcctagaatttaaattggcagatactactttggtataaaatgctttctatggacagtattaatattttaaaatgttttactcctgcagatttccagtagacaggaagtctagctctgtttaccctttggctactaatgagtgctgctgaatgattatttatcatctttaggtagaggtaccacaggtatgagatcagaattgccaagtaaggcaagcatttaattttaaaatttgaaaacaaatccatgcaaaggtgacaactaaagtatagatactcgaaagaattttggacttgagtcagaaaatctcagttgtatccctacccttgtcattaacttagctgagtcaccttgagtaagtcactgcccaactccagattacagtattctctctaaaagcacaatttcaacattgcatattctaaagagagcttggttaaggaaagcttggttgaggaaagctgaatcttgttgtttatcagctatccacaccagcctggcagctctgaggtcagtctccagctgtattttcatctttttgtaatctcttaaatccttgcaggctttcattgctagttcatttccctagaaatttacatttagagacattgaggacttcctacctttgtaatttttctgtgttcatgaatttaatgaaaaattacttagagctggctaaaaaatgcaagaatcaaaagtcttgtttaaatgtctctgtaaaatcagactattcccatcatgactaacaacctttactatttcagagttttgaaatcagtatgtttgaatcttgacatggtgaggcaccattgtcattttatcccattcattgttctagcattttcctactaactccttgttctaaacattcttctttttttttaagcctagaatgagtgaacaaacaacaaggctccatgtcatgagaaaagcactgtagcctgatcttcacttatgttttaggtatttgaaaattacattgatttcaaatagtttgaactgcattgagctaaaacttatcttttattggtctgctaggaaatgaactaaacaaaataacttgcctcaaagtattgagaaattaactgtatagcgacttcagcatgtgtatttttaaaatgaaaaagctagagctaggtacaaaatgtgcttcattaaaggaggtctagcactatattcaaaaggtcaaacaacaacaaatattggtgtggatgtggagaaactggaactcatacattgctgctgggaaagtagaatcgtgcagccattgtgagaaatagttcattggttcctcaaaaagttaaaggtagaattacctttatgatccagcagttccactcctagctatctatccaagagaaatgaaaacatacatccacattaaaacttatacatcaattccctagcagcactatttataatagccaaaaagtgggaacagcccaaatgtccatcaaccaatgaataggtaacaaaatttggtgtatccatacaatgaaatattattaggcaatgaaaagaatgaagtactgatacatgctacaacatggatgaaatctcaaaaatatgctaagtgaaagaagccagacgctaaaggcaatatattgtatgatttcatttatacagaatgtccagaataggcaaatccatagaaacaaagtagattaatggtttccaggagctgggagtggtgccaatatgcagtgactgctattgggtacgtagtttcttttaaggatgatgaaaatgttctaatattgcataatggtgatggttgcacaactgtgaatatactaaaagccattgaattatatactttaaaagggtgaattttgtggtatgtgaattatatctcaataaaagtgttatggattaaaaacattagtgactgtattactataactatttgaaattataaaagtatatttaaattacattttatgccaggactaggggcgggggggaatggggagttagtatttaatgggtgcagagtttcagtttggaaagatgaaaaagttctggagatggaagatagtgatagatacccaacaaatatatttaattttacagaactatatacttaacaatggctaaaatagtaattttatgttatgtatattttaccacagtaaaaaaatccataaccccctaagattatattttatattattctaatgaatgatgtgtcttttactctttttcttcttttaacagtaaaactgaaaatgtgattggccttttgttttttatgcatataattcttctggtctgtattttagaacttctttcctgtgtggcgttgggggatgcgggtggttacacacacacgtctttatcttggctttgaatgagaacttggaagtattttttaaaacttttatttgtcagtaggaaaataaaagaagccaaaccataggaaatttacgtaattaaattataaaatagtgaaatgctgttctcagagtatgaattatcacagatttcctgattttcttggttaatcttggcatcttgaatgggaaaaacatatatacttttatacatatataacatctctgtatcttcctataagcattttcctttgtatagcaggataaaatgagcaccaaaatgtggtgcaaatataaaaacgcagtggatgagcttcaaaatgcaaacaaagggatgggaaaatgaaaaaaagaaaattcagcagtgagaaagtcactgaaaaaggaattaaattctttccaagtctatggaactatgttatgacccaagcagtttgtagagtctgagtttgtaacctctgaggataaatccatgaaaatatttctaagcctggctactatctaggacatttgaagatggatgttatgaataccagtagtgccattaatatagtaggcaatcagaggtatgtttgtttttcttaatcaggaagtggtttcttttaaaagtataaggaacacacactgtgtgtgtgtgtgtgtgtgtgtgtgtgtgtgtgtgtgtattttctattccgttgcaggaagaattatggtttttccacattttacagtggggttttctagagtttggcactatgatatcctacacttgattacaggatccaatcagagttgatgtactcagaaattcattgacatgattaatggtctcctaatcatacttttatttcctagattagccctatttcctgtagtttcacaatttttgagtcatatgttaaattatcctttattgggggcctgaaattcttatgagtatttttagtctataatttgcatgattatttcttttctttgttttttttttaattgaagaaaatgaaattttgatcttcctttgaattctttgagtgctgttctatggtgactggccttcctagtataatcttttttaaaacaatattgtatatatgtgtatgtttgtatacatatatatgtatacatacacacacacatatacacacacatatatatataattttactgccaccagcactagatccagaaatcttcctacaagtttccactagtctagtttttattcttctcaaaagcaaaataaaacattcttagattctacaagtagcagggaaagacatcaggaaatggctgtacaggaaatgtaattgatgattctctctttacaattgaagtggtcacaagattggctagcaaacacaatctattaaatgaaaaaaaaggtgacttctaaaatctttggggaatttgaatacatttgaagcttgttggtacctttgacatcttactgattctttttgaaactcttacctttttcaaacaattgtttgcatttgaaattgggaactttcatatccagtgattgctttaatatttgctttgtttttaacagtgcccttaaagatagccgttttcccccaatgacaagggatgagctgccacggcttttctgctcagtgtctctgctcactaactttgaagatgtctgtgattatttggactgggaggtaagattatagaaaaatttttaaagaaaaatgaaggtaactcttgaggagatgttaaaaattaggcccagaaaataactctttcagcccattctctattgtaatggaggtcgagagtaatatggatgaataaacctcacaactgaacgagatataagtaaatgagttttttaaaggacaaagtgccacgtgttgttataatccccaaactgaatttggttttcatttttctcctactacctcaccaaagcacctcataaaagctgttaataagtaataagaaggactgactggaatttatttctcctcttactttcattctggtgcactctggtataaccgccactaagtaactagttggtcagaggatacatctcagaaacaagaagaaatatttaggataatacaccatttgggggaatcagcttgtgataacaacaaggtattgattaactagagttaaataatgtgaattcattcttggctaccttagtttatacacttaaacactctaacaaataatactaaggttatttctagggtatctctgtgcattgctattgttagagtagcttatattgatcatatttttattcttctttagtacatggggttggctaacattgttagtgaagttcaaaggttctcaccatgatttgctttggtggctgggaggagatgttgagtgtaggtctattgggtctatgaaattttacacacaagcatgcccatattactgaatgcctgttttattccaggcaatgtgctccatgtataaaagtggtaagatttggttcccaccatgaagcatgtcataatttagtggcgagtaaatgtgtatagaaagtatgaagaaataagtgctatgagaatgaaacaatgggaactcagtgataaacataacattctctctcacacatacactcataaatggcattattgtatccttatgacagattttaattcttctgctgttttagaaggaccatcccccatagtaactgaactattctgccttggagacagatcactgtcttcacagtttattagacttgaatttaattttggctttgccctgattccttgtgagactttgaacaatttacttactccactgcaattcagttttccaatatacagaataagacatttataaggttcttcatttgaaaaaaaactctatgatataaattattgttgttataccagagctatttaaaaagttttagggggtggggtgaaaaaaaacttttctacagagagtacaatgctagagtcccctctgggttttgtgctaagattttctggagcattatcagaatatgaacacatcttaggatttttgcaaaggaagaaataaaataaatttatactgttgttcctaccaaagttggaatgtagaaaaccttttgtaaacttgaaatttctgatttattatttgctataagtttgttgttcttacttgatttttcttaaagaaaagtctacaaatattatggaaatattccttagtactttatttttaaacagccccaaatcatgttccctacttattaacatatattatagtctgggtggttcttttactgttttaaggctgctgtttcctcttccgcagccagatttacttttgctttctggattgcagggtgttgtgtatgtagtagtggggatgggagtgattatatgggaaaagcctgagatccaagggggatgaccaagctacaagaacacttctactcttgcagctactgagttggaagtacagttctggcatgtgtgtttctgtgtgtgtgcatgtgtgtgtgtcacaaacatgaacatactagtattacataaatgtgtgtgcatgtgttttgggggaaggaaaaaggggagaatacaacagctgttacataggcatggttaagcaccgagtacatcatcatcatctttagcccagttaaagcactatctacagctaaaattaaccttgatattattggactattatgtccaaaagatacatcagctttctgtttgttaggagagtgggatgtaaagcccttaagaagtagtactgtgtactccactatatactctttcaaggcatatttatcctctttggtcaccatctgccagcctgaatttccagaagattctatattgttcctacttggtattgtgtatttaatatattttagggggcttaaatattaatttctattaagtattagttccctattgaagcaaaaaatacactttttttttttttcgagacagagtctcgctcagtcgcccaggctggactgcagtggcgtgatctcagtacactgcaagctccgcctcctgggttcacgccattctcctgcctcagcctcctgagtagctgggactacaggcgcccaccactatgactggctaattttttgtatttttagtagagatggggtttcaccgtgttatccaggatggtctcgatctcctgacctcgtgatccacccacctcggcctcccaaagtgctgggattacaggcgtgagccaccgtgcctggcccccattttttttttttacttttaatatacaagtatttgaaagtgaattagttactgttagaatggctatgctaagaggaaaagcccatccttttcagttagttcatcattgtttcaggtatttggcagaagagaaatttgtatacaacgaataagggtggaaattatatttttaagtacaagaatgtgatttggtcttaaaaaaatatgtaccttactcagtgattgaaaatggagtaatagtattgtgggaatgatattctaagggttatccttaatgattctgaaaaagcattactaaacacagaatgccaaaatggaattaaaggcattaaaaaattatacgttgacacaatttcacttctaggtatatacccaaaagaattgaagtgttgaaacaaaaacttgtgcatgaatgttcataacagcactgttcacaatagccagaaggtggaaacatcccaaatgtttatcaacagatgaatggataaatagaatatgttatattcatacaattgaacattactcagccataaaaagaagtgaaatacatgctacaacatgaatgaaccatgaatacattatgctaagtgaaagaagtgaaacacagaaagccacattccgtatgactccatttatgtgagatatccagaatgagcaaatccatagagatagaaagcagattaatagttgctaggggctagggggaggggtaaatgggaagtgactacttaatggtacagggttgccatttggagtggtgagaaagttctggaaccagatagtggtggtggttgtacaatattgtgaatgtatttaataccactgaattgtacactttaaaattgttaaaatggcaaattttatgtgtattttactacaataaaaatggaaaataaactttatacatatattctgttcataatagcaattttaacttatcaaagaagaaaattttttaaattaaaaacatataatgagagaaatgtgagtcatttataattacaccattctgagaataactactgttaacattttggaatatttctttccattatcttttatatattatactaagactttttaaaattttttttccattctttatctgtctttgtatcaataaatctgaatatttggttacataacagatcatattgaatatgcaatcactatttaaaagattgtggggaagtctttatggtttatctttgtatataagtaaattatattttgaatttcctttttgagaagtcagtctatattatgaaagtatatgcttcacgagaattttcacactaataggtacaacttttcttccaagaaaaaatatcctattcaccataagtatgcaattttaacctgaaatgtgaagtcctgtgtatgtttatgccacaggggaaaacaaggagattattacagaattttaatacagaatgttaaagttgaagatagataatgagcatgttttatacaaacagaagcttctaacgtagcacttttctggtggaagtacagtttgagaattgacccccactggttaagtgtgttactgcagtggaattcctaattaaagggatgaaaatgcccagattaaagcaggaagagggcaaagtctagaagtcccaaagcatagaggtagatatcttcgctaccaagacagatatccctgtggtcatgaggatgaggaacgtgaccacgatcagtggtaatagccacccagttttcagatgatcaggaaacaaatgaattgccacgcgtctggctaccatcttactgtctttttcatgcaaggtttttaactcggtctatttgggaactttcttctgataacatgtctctaattttataatggaagttagtaggaaagtaggatttactttagaccttgttttaggagctagagtgcttctgtttgataatgtgagggatgtttgacaaatggttttacaaatggctgtaactaatttcaagtcaatattgaattgacagactaatcaataatgcttccatatgttctatttcctcagaatagtaattataacatttaaaataagtgtttatgggtagcctctgaaggaatctgggcagtcattaaaaataacagccatccacaaaaggcagtaaggacaaattagagcagtggccccacccttccaagaataactgatcattgcccacatcatgatgtacttattgtcctagtaggtatgagaaggatgaagagtgaataatttgaggaaaaatttcattagctgataaattggaatgtctacctgcaaggctaaaatggttgttaaatgaggaaaattgctcccctagataaatctgacatgatatgctttgtgtttgaacacggaaactcatcaccattgttctgtgttcttcagttgacatcattttcttaattctgaatgacagggtgattgacagacatggtgctttgtaaagaaagaaaaactcatgcagcatgttggagcctgccaaaatgacatagcctggaacttgtagagttaaactgtttgggagccatgtttcctttttaaaaatctgaaaggatataaaaccagacattacaatggactggagcttgacttgaggggtgattctatgtgtgtcacctcataggtgctcattttcaggatgatataaatgaataaactttttgtttgtagaagaattcgtatagcaagtatgttaccagtgattttgtggaagctaatgtagcaatttgctgacagaagtcaaaatattttctaaattgtaatcaagcgtcttttacttctgtgctttagagacaagatcacttgaaggcatgaagtaaaaatattctctgtattctaaagtaactccttagatcagatttcaaaagattaatgacattttcacaaaccattagtcactttctcctatatctggctacctggatcactggtatctcactttttctatacagctgtcacctgggcaatacattgtggtcccaagacagactgttccattggagcacacaatacgtacatggaatcaacccatgctgggtggggctggccagcacagttattgtatgatgccaaaaatctgtccctggactataaagctatacctcaggcccctgatctcactctgtccctaaagtaccaaagcatctgtcattgtatttgagcctcgttggactcctggtactcagaaagctgtgtttcactttaaaagcaacctccaaggcacacctcttgagtgatcacagctcaattctgacgtgttcagttgcagttaataatagggtgcttttgtaacaaccttcgtgagagtaaacagatgagatgaataaattggctactgtcattatctcccacatattttagaagttaatgttcttttcaccctcactccccccttaaaggtttacattttttagctcctcttaatgtgccattgaaaacagagttcccattcatacacagatggtaagcatgactcatgaagtcacccagcgaaatgacttctggttgtatatgttatgtttcccctcttggttagtttttcccaactatgatatacatcatgttttttctctcttctaacttaaaaaatatgagcttcatatatccaggaaaatgcttttcacagtacatattttcccagggacgttgagtttttttataagatgtcactatcattaagattagtcctttcttgatgctctactttaaatgttttttttttttttaagtgccgtggagtgttgggaaaggaaggcttcaggcttcctggccatctagaaagagtttgctgtgcatcaacaagtcaatgtataagaagcctagtggggaagcaagctgtacaaagtaaagtaacttcttagaaggtgatttaatgcatacaaatttccattagctgttggttctcttagcaaaatgcgctgctgattagtcccttctcaggccgcctcaagttgtctccagttttactcgcagcatgtttattggttggaggaagttagcctgctgcttccccagaattccataaactccctgccccttccctagtacttttgttatagctattatttcatgtatgatttgcctgtgtgtgtgtgtgtgtgtgtgtccccagcatttaattaaaagaatgctgaattttgggaataaggagacctgggttctgttcctgactgccactgcccagctctgtgagctttctgggcctcagtttcttcaggaacctgaagaagttggactaagtgatacctaagatctctttggactctgacagaatatgattctgtgacatactcctttttaaaagatggcttctgtttcattgtccagagaatgaatcaccactagccatttagaagtcttaagaagaggtccctaactttcaaagtggccattgccaagttaaatgtaggcaacaaacgtgaaaaacagtccagtttttaagttgtaccttctagatttcctgttcacaaaaagaattcccttgaggaagaaaaatgctctaagccattaatgtctccatttaattactgtatcatcctgttttaagtcaacattatatatttaagtctaaattaggcaaatacattagggagcgattcactttatgaatacgtattttgctttgtagaagaactcactatagaatgttattgttttcctcttgactttaagattaattcatttatgtaaactcaacccacatgtaactttttaggaacaaatttcttttgtagactaagttaaactgtattgagtcagatactcaatgtacagttctaatgaatacaattttatttttcttaatttcttattaggcaaacagcattatttcatattaggcatgtttgctaggaggtgatttcttccccccgcccaccctgtccccactagcctttggaaagtaaactaagtcacatctctaggttttgagaaaattttataactttagttttcttgtctgtaaattcactcccttattcccttttttaagaaatggaaggaatgcatttttctaactttgatagaaagcacgctttttatttaaaggtcacctgtgctgcctgaacatttcttgggaagctttaggatgttaagtttttatgggatgctcattataattaatcattacagagaattgggggttttttccccttaattgcactctgagctgtcacttgttctctgcaaaatcttagagtaagatcaatttccttcattgcaaaagatatataaacatgtttggcttcagagtttttcaaagcacctcttcattagccatactttatttaaaattttactaaaatttcatggtgactattagagagatcaggtattttaaagctgtgtgtcagctattaaaataaatgttaccagatcgttgttcagtggcttttgtgaaataagttggcaggcttttgttcctgatagacaagtagtctgtctcctacataaatcaaaattggccctaattagtcctttggtaagctctgtaaaagccaagaattggttcatggagactgaactaatatctaagccaaaggtgactaatctgcagggattttaaagaagagcaacacatatgtattttggtcaaggggacctttttcataaagtaacaactgagaaaaaaagaaaaacttcagctgagacagatgatgaagcagaggttttatagtagagtacgttaaaaggttagtcatgctcaggtgatgactttgtaatcaattatcctttttgattcatgtttctggtattctgcttctaaacgcatctcaaaggatatttgaaaataaagacaggtataggaactggtcagataatgtataaaaacagcctaaaatatagtctgtggtggtatctcagttggttcaggagaaaaataatttttacgtcactaagataagagttatctctagtcggatggtactaggattacaggccatctttattttctcctttatgctttcctaaaaggatgctttatttgtttgtttgtttgtttgttttttagagacagagtcttgctctgttgtcgaggctggtctcagactcctggcttcaagtgatcctcctgcctcagcctcccaagtagctgggacaacaggctcgagccactctgcctggctctaaagggaatttttttgtaagacatatgtcctccttttataaaccagaaaaaaagatgcatgtttacagtttctaaggtttacaagagtaaataatactcagcaaaaacaaaagctgaatcgcagcaacattgttataaaaatttacaatttggccagattatgaagggatcatgttagatagatatgtaccttcagaactccagaattgcttttcaaattggtggtcaggttgaagtgatgcagagtaacaactgtgaggatttgatgggcagatcgagataatatgtcatctaaatttttttttttggtagtatcagatttggggaaagtggttcattaggatctgtacaaatccttatcagcttctatgattaaattcttaacttttctagctcaaagaattatccaagagaaacttggagtaggcctaagttcgaagtatttttctcttttatgttgaatttgctttcactaggaaaaggaagagtttctgttttcaaaaggctaagctggagtagtagggcagaaggaactgtggggcaataagttcaagagtggaccatgctgcaccatgagttttgtgctgttaggagatatagcacatagttttttcctcctaagaatgtcagaaacaccagactctgggtcagacccatggactgtccaatacagtgtttgtttctggctgtggtacccagggttgttttgtgagagagcatgcattccttctgtgataccagcctctaaaggttagggggtgtgccaaacatcctgagctcctctcattaggaacagtgtcctttcattcacttcaattggactggcatattgagcgtggcaggtcagtcttatgtgaatggccagtaactggatgctttgttaattgcaaagcatattttgccaaatgatttcatccaaaaagacatgtcaaacaactttcgattctttgacctcctgatatttcttatgctattcagatgaactcactgaaaatgagtagagtaagccatggccatattattacagggaaacccagcatttggttctgaaaatggggaagaatgggactgaccatggtatttgctaaaacaggatgccacccaaggtagtagagtgattctgttggccaggatgtaattgggaagatttagctttgagggtcaggactatggagataattgtggacccaaactgtcagaagtttacatggaggctactcaacttagccagagcacattttatactcatttatgcttttagccagatgactctttttcatgttttagcatattcagattgttggcttgctgacaaggctcacaagtaaaagtgagactcttttgtagtgctgcttgtggatcacaaggctaacacttgccttattagacagactagggtatattaagctttgactgtgcaattacaaggaatataatatgggagaaggtacttttaaaaaatgctcttgtgttgagggtcactgcattagaggataatagttttaaatgaagccacatttctaacacgggactagataacaaggataaatgaaatctgcagacagtctcaaagcttaattttagccattatttataatctcttctcctaccaaaccttttactgtgtagcaaaattgattaatttgtgtgtacctcttctttctgtgaccacgtgctatctgatagaggagtgaaaaaatagagaaatggacaagagacgaaagaggatggggctgaggccaggtggagctggggatgcataatccctaaactggataatcaaccccagaataatcaagatatattttagggtcttaacattaatcttgatatttaatcattctgaacaatgttaaaaacaaaagattgtataatagcattaataaaaatcacttgctatggaatggttcagaataaatatggctttctttttagcatgaaatatgaatccgttgaactggtcttaatgttctatcagcacacacagatacagctctgcttaattccatatcctcttatctataagtcctacatttaatttactaccattggggttgatttttagctttgcttagcaaaagtagtcttgattaaaagaatattatcgcaactgatggacctcgaaagcatttttttcatagaccatctagtaattttgaaaatgacctgcagacccataaggctagatttgcaagtttccagtttgtacccacctggctgtacttcaaacagtggcaggattagttaggggtatgtttagtgacatagtattcccacatgctgccccctcatccatacgtagaaagttaccgtggtagtgttttaaagatctgcttcggggaatcccagttccctggttcgctgatcttttatctagtttataattgcaactatagcctttgtctcttgggatgttgctgggccagaggattctccaatatgtataagggaagattcaattatgcatgagggttacattttggagttgtagctgtgacagatgcctccctgaaacaatatggaattagttttggtgctcatttcattgcaaagccagtgatttccacaggttggccagaattggtcattctccacagcaggccatgttctccttctcctgttttgattgttcagtatgactatttagtggcttgtggttctaggagtaaagaaaatgctgttgctcaagaggtaacagaaagaaagctactatgattttgttaagaacattattaccattctcctaattctactagctgaaaaaaatgagtcactctggtttgggctttgtagctttgtgggagtatttttgacctatgaaaaaagttcataaaaagaattcactttaaaaccactatacttacagttcaatttacaggggctttcaattgttcagagtcataggaacccagaaaagaattaaaagttgtaaatgtggtactaaatcaaaattggagaatttggggtttttttcttatcaaatttgatggtaggaccttctcaaaatgcagagtaaataaagcagtcttattcgtgagtaatttttgttttggccaatatgtcctttgtatccatacacacacagctttattgtgataccattcacataccatacaatcagtcttaacttcttttaattattaaattactagacattaaaaatctgatatttttgttcaagaacacaggatgtactcctataaagaaaggacttaagtgtctaaattaaccccatttgcctaaatcacttttaaaaatcttagtatgtagccacagtttgtcagaactagaatgcttattagaggttatctagttcaattagaataaaaattacctggggagctgttctttttccaaaacgtatttgttgaaattctgataaactttgcagccccgctccccaccccttgccagttaaatatcattaattttgtctgacactctcatctcacagatagggagacattcttcctatcacaattttgactagacaccttaataaacaccaaaattcttttcaattttaacatgacgggtttttgataaatagagttgaagattcaaaattcacttcagtggatgatggagtataaattacttatgctgtgtatcttttaaaaaacaaattatgaggaatctgatattgtcaaaggaaaaaaaaattcaaagctactgatcaggaagtcagtatacaggaaattttgcaaatttgtcattgtctcatcaggcactggagagattagtagatgtcctttatcctggaaatgcctgatagctaagcgctcatatttcttctcagctatatacgtagttatttcccacacagtatgggaggcaagtattgtgttagtttttaaacagctaccctggtcgcatttttagcagaaagagattcgtaagagtactgatattaaatagatagaagaaatagccagagatatgctttaataaaaataaaaaaccataaattcctcagaagatctgacaggctctaatggatagatgtgtgaagacctggggaaagatgaaatggattttcccagaggactttttattcctgaaaaaattggaaaatttgagactgggggtagaagaagcaaaagaagttttcattgaccccctttcctcttctagacctttacatccatacacatggaaagtataaaggtttatgactttactcacctgctctgaaaagaagcctccatcttgggtaataatgtttacctggtcttacatctccattccagtaccttgcacaacctgaccctccacttgggaaccattgatctgaggcaaccacagatccaagagaacagaatggtgtcattatgcttttgaaatttcgtttttattatcaatgttcacaaagaagttaagaacttttaattttgatctttagctctgtatactattctatgtgagatatgaggggaaaggacagatttctttcaatcatatgctaatcaaaggaaaagcacattattaaaaaaaaattagcaagaaattgctcacagttacttagaagactacctttttaagggcatcaccacaagcttgttttacattaaaaagttacagtggtctctgggctagtatataaagagactgcaataatgcactacagtgaagtgatttgaaatctttattcttaaatttagtagagctgtgtgaagacaatggtgtagatggacagtgaaggtctgctactaccccactctaagtcataatgcatttttaaagaaatgctgtctacactgggtgatgatgtaggatctggttgttttcattattaattttcaatcttacctgactgtgtttgcttgcctacgtataatttaatgttttaaacggagtagacagtttgggaggggatcagcaccaaaaattttggaacttaatcagaagtggtgagtgtacctgcaaaacaggatggttgtttgctatctctttgaagtcagtcacctttgtctctagttctttattggcatgagctacaatttgggagtggggcaggatttttgccatcaaccgtcttattctacagacagcttcagaatagttgttccagttttccaaacatagtatcatagcctagtgcatgttgggcacatgcaaatcaatattttccctctccgtggccatcataatggccttcaaatccaaagtcaaagctttggaaagagaaaacttatacgtccttctaaaaacaaagggaaaggaagaactgcattctcttgaaagttaaattataaccttttctttctgattctatgaagaagactgtactaataaaactgccaatttctttcaggtgggtgtacatggcattagaatagaattcatcaatgaaaaaggatcaaaacgcaccgccacctacctaccggaggttgcaaaggagcaaggtcattgttgtactttatttcatatgatctggtgaagaatttaaacaaatatacaaactgaaatgcgttatctgaccttgcagttatgtctaataattgaagtgtcaaattataagaagtgactcttccatcactgccactgcaatgtctgtatcaagtcggtgaagtactcacagaagttgaatccctgcattgaagtttgatggcataaacccataagtgtatattttttaaaaagcagaatttatattagttggttttcattttaggcaacaatttgctaccgatttgaaatgcatttttcccatattccattgtggcataaacaagccttttgtttgacaatcagccacatagttctttgtcattttaagtatcaaatgtttcattcttaggtggttgccattactcatcctgctgatactaagattctaggtttcccactaagatcagaggattgcgaaaacatgaagtgttagtgttttatatgcttggtctacacttcctaatcagaattttcctgtttcacacatagagcatagacctgtatgaaccaacattgtaacacaaagtaacttttcactctgtagtattttatcctttcttagcaactactaaattctggtttcatgttggtcgaaatgaatcttttatcttggggagcttttcttctcatcagaaagcatttgtaatttggttttcccgtgtttgtcttataaatgtgagatacataatagcaaaattaatgccattaaatccccagatcagaaagtcttcaaggcagttacttgaagatttatttgggttgctttagaaaatgtcttaatctcctagtatcattaactttgtaaagcatacataaaagatagagggcctcagatactagtataccatccatgtcagaactaatcaaaatacccttgaatactgcacacaaacttgaatgattacagaattacagaagataccataaggaacaacaattactgtgaggtggtgtgggagtcctaaatattgacttggcaaaatggcatataggcttttcactcccttttaaagatgtcactgttagaggaaagtacaacagatatggtttgttacagtcatgactgagcaatttctgccagccccttagaccccttgacttcgaatgcgaagataaaggagccagtgttgtttggcattgtggatagctagaatttaaggagtgtggtgatgaccctgcttttgtaaaggatgaaatcttagcttttctgtgtgattgtttttaggaccaaaagatttgatggcatttggtgacagtgatagctgacctctacaaagtcattttgtatttaatgaaaggtgtttgttacatgtgcttgactgatattttatctggtcatctctctacaggatgggaccatatacagaccatagactccttattgaggaaaggaggatacaaagctccgattactaatgaattcaggaaaaccataaaactgaccaggtacagaagacattttctagcacaaggctaacctgtacattttgatgtgtatgcctataaccctttgatttctttggtctctctaactacacttcttttttctgaaacagagtggaaatgaatggcagggtcatactgagggtggatacaatggaactctgcttcgtagtaaagcctgtgtgatgtatgagcctatctttcccatctttagctctgtgtgattactctggcttttgtacgagcaagcccttggagattttagactactttattggagaaagtacttgaattagcaattggctagcttttgacattactgagcagaaccccaggattctgataaacagtcctcaaattcgaatttaatctcagaattttggcagtgatagaagtctaccaagaaaacttgttagcttgctgaaaaacacaattgagctaaactcaaatgctaaataaatttcagcatgaaaaaatagggatgcttatttaaaaaggaaaataccgtacattttaggaaaatgggctgctggttccatttatttcaattccataaaactacattgaatgcttatagtctaaaaatggcctattctcagctctgaggagttacaaattcagaaatacctccatctctgctctccctgagttcacagtggaggagaatagaaggggcatggacaaaattattaatctaaggcagaatatgatggataatatgagatccattcccataaagtagggaaagaggaattctaagagggtgggagggggataacagatagtttcaaagaggtcagctgggggctgggtttgaagaatggatagaatatttgacaggtaaaaagggatttttttttgacaggaggaaagtgattcccttaaggaagaccttgtgagtcaagggtggtgaagtacaaagcaagttctgagaatatgaaatagtctgattgggctggtcttttagtgtaatagagaagctgatcattagaggaaaatatggcccagaaggtaggttgggcagaccattgagggtcctgagttccagagtaattagtttggacctggttctataggcaattggtagctattgaaggattttaatcagatgggcttggggaggtataagaatggaattggaaacaggaaaatgagccaggaagcgttggtattatctaagaatctgtggcagcagtccaaaagaggtgcaacaggggccttaactagagctgtggcagtgagatgggaagaaaggttgggatcgatatgaaaataatgtggaagaaatgaaaggactgggtcatcatttagaaataaagaagaaagtcaaggcgttaatctagataaaagggaccaaggtaatccctttaatcaaagtagggaccacaagaggagtgtgttaagtttatgcatcgattttggatttgaggtgcttcttaggatatctatatagaaatatctagtaggtcaatgaaaatgtatgagctcatggctagatatgattgaaattgtaaggatagggttcactgtggggggacagtatagagtcaaaataactgaatacagaaacataacaaaattctacaaggcagggataggagcattcagagacaaggagcaatctgagaggcaggggagaaccaggggcatgtggaggtatagaatccttagcaccagagagcttaagggcatgatgggcaaatggaaagatcaagctgagtcaggggaagccttctgatggctatttccatggaagggtggcagcagaagccaaggagcactgagctgagtagtagtgtgagatggggattgaaggcagaaaatacacacaactatttgagaaatgtggcaatgaaaagaaagccagacatggggaaaagtgagagttcaggataccagaattaagaaaagttgtttttgttgttgttacttaatggtaagacctaagtagatgtgtggacagagaaaggaacagtaaaagagggagaggtggaagatttctgaagaaaaataatcaactgaatcgaatgagatgcatactcctgttagaaaactggggctgaggggacaataaaatttttaaaagaacaatttaaacaaggagtagtagagtgcaaagagcactggactcagacttttgatttccaagttctgatcttagctttgctacttactatctctgtgaccttgggcagtcactgcttctctctgggaccccgtttcctgatctataaaattatctttaaggtccttcctagcagtgacaatggcatgtcacctacttctcaatgttaacttttctcttccctgactttctttcaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccgag

SEQ ID NO: 1197 - DNA, 66077 bp, mus musculus
gcccttctttccccgccctctactccgccttcctccctcgtccacccctcccgccgccctgctccggggcggtcctagccgctcaccgcaagaagaaaagccacccgttcgtccccctcccctacctcccatcctttgcccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcaggggtaggagacgcgtggttacttttcgcggggaactggggcaggaatccatggtggcatgaacttggtcgtgccctcggcgtgagtgaatcgatctaggcgcgtgtgggaatgcccgtgtgttctactttctttgcagctcgccatgagtttttttggatgtgcagcaagttaaatcggttagagtgtgcgctgctttcccgtcctacttcggtgaggagatgctagtgggtaccactactagatggtacttttacttctttacctcctggggttcttgtgggtctctaggtaattaatcacattgaggagctaaagacccgagggaagctgaaatctacatttagcccagcatgcatgtcagtgcttatctcagataactagataggtttctgctaagtgcttaggcttggggtggggactcacactccctgaggcgggagcaggaggggtaggaccgtgaattcttgaagttttaaagtctgtgtaatctaaaacaaggctactctttgagatgtgtggtggtggtggtagtgcttgtggtggtagtgatagtggtggtgaggagggagttgcccctatctgctttagaagatccaaagatgttagtaaatagttttgggggatcttgagggtgtcttgagggtccaagcctgggccactgcacattggtgcttcaacagtaagatgggcttcatgggtttgtgaaaatgaagagaaagaaaagggggagggaaaataacagtctttaatagactgtgagcagttcctggtagattgccactaataataatataataatttgcataaagggactaagtagaattaaatgagcaaggaaagagaaagttggtgagaaacagcattttcaatctctagtgtatgttttagaacgaacttttcaacaacctgggatgtttagtgcatgaagttctcctccctccccgccatgaagagtggacgttgggaggcagtttaaaacttttatgaatataaccctcttctcccattcagagaagaagataattagtcaccataatcttcaatgatgaagggctaaggatatttaagtctccttgagctaggctttgtgaaaagttctttctcaggccagcctttgtgaagccttctcagttagacctttcagcaccctcatttagtagctaagaatagtttgaaatgccattttggatgtggtatacattttcatccatctcccacctatcttcaattggacaagtgcgtcaagcctgtaagtgatggtgttcaaagacttattactgagatgtccttaacccattgcttatttgggaacacattattaacatacattttaaaataactttggttgattttaatgagtgaaaggaaagtaggaaggtagagaagggcgacaattttaaaggctatcctgtttcagatcagctgggagggaaaagctggcctgaccaaactacattttataactggcctgggacattttaacagccaggtggttgtagagtagttgcctctatttacagatgataactaaggttccaactattctgtatgggtttatccggcgtcattgacagacactttctggcactacatcatacttcattttaaattacttctttccttggaaaagttcgtggctttgtaaaattgtaagtgctttttctaccttcacagtctagatgtgaagtaaacctctgaccacaattgtatgtggagtcacttttacatgaaatttgtggatctgtttacctatttaaaagattttagaaagggaattttaataattcatagtcaatgcagttttggatttggaaattaaaatttcatttctggtttatgaagtttgatttattagactaattcccaacaaggacatttgtagagttgctttttctttctgaggttttgtaaagactgcatcagactctagaatgctttaagaatagcctaatcagaaggcagggggatggatactatgaccttgaggtcccattgagtgccagaattctaagtgggtacatctgcttctgtgcctctcccaagagccctctcccagggcctgcgccttctttaaaagggtgtctttgtaattaagcggcccttcttccccatccccctttcttcctttgatccagctttttaaggcctttttttccatttggagacaagaggggtttctcacactttcctgttcccctcttaacgcttcttttcctttaccccagaaaagtcccctgaagttctcaggatggttagaagttgttttgttttgtttggggcgtgggggtggagtgggggagttgttaccaatgaggaggaatagaggatatattccctcttgggaaatgcttgtgaccaggtagcctcctccatggagactgagcatttggaatgcatgagaacagtctattcttggggactgtctggtagaaattgtcctttgcacccattaagcccagcttaaacactgaaaggggtggggagaggtgtgtgtggtcgtactggagccttttaggatggtaaatgggtaaatgtttccaaatctcctattacatcatctctttctcccatggattcagtaggtttagtgatctgcttgacaagttaattagctggggactaaaccaatttgtttagaattgtgatccattgatttcctgtccccaggaatttttgttggtgttttactatgatgtgttgtctttagtcttacttacttttccctccttgctgccttttgtggactttggtccaaattctagggttccacccccaagtcaaaggttagaattttgtcccaggaactaagggggtattaaacaggctggccatactgcattactctcctccatggtgggcttctgaccccttttaacccagagaaaggagggaagtcgccccttccacacacaacacacacaatctgaacaaaaaaaaagaaaaagaaaaagaaagaaagaaaataggaggtcatttgctttataaaagaatccacaacaggttttctttgtaagtactagctttcctagttagtgcctttaaactatgacttgatatataaaaattcactctaactgggccttctcggaagcatatttattgcataaaggaatacataagaatttgtaatgattatcgcttaaattaagtgaggccattatttggcctttgaaatctttttgttatatggaatggagttagttaattgtctaaatcattctggcttgtaataatgctggccacgttagctctggcctacaactgcttgcagaagaaagctagtattactttttgaaaataaatcagactttatagattttgaacaattctaaggatgagactatccaccccatataggtaaaatgttttatttccagctactgtatttgactaacccagggatccagaaagttatttctagtaaataatggcgactgatgccactttaacctaagaatctgcaataagatttcctagtgagcctattggtgagaaggacctgggctctaggcccaactgtaactcggtttactacctctgttaagtttttttttttccactgtaaattatgggtttggacagggtaattttgagagccagttcttatacgtttatggttttctttctaggcctcaatatctagtatgaatgtgaatgattgctactagaatgaagtgcaacagttgttagaaattcaatcatctagtcatcatgttaaagaaaaaaagatcctgtaaggatatatgaatatagatgcattatgttttacattttaacaacccaaaattaagaagctaagactctgtccaaaacttcaagaattccatcatcctaagagatcacctgctttcattttttctagttcctttcaagtcctggttcctgtactaacatgagttttagataattggagccacagatatatacaatgttgcttttcaataagagcccacccaagacttaactttgtgaacccatgtggaggaactaagtcagaatctgaccgaggacacatgaagactcccatatattttgtttctcaaatgccaggagaggctaatggatataataagtaatccctaaacactctctgtgattcaggagttgttcatgtatctagcaaggctgttaatttaattcctttgacctcctgttatccctcccccattcttgttaacaacaacaacaacaaaactagggtccactgtttactttgtgtaaatcattggcaatgatttttaagtcactgtatggtgaaatcccatcaagtgagtataaatttgagtggaatatgaaatctccagaatgagaaaggagaagcaggaaagcacaaatatacttgttttgtagcatggaaaataatatgtttaaattagactaaaagatagcaaagaaactaaggattttagacagttaaataaaagacaagaagtgcagcagcagaatggcccacacataatgggttcttcatctgaggtcttcaccatgtagtcaaatttcatagttctttaattttcctttgataacaaaggtgtggtatacatgtgatctctaagatttgatggattagccaggcatggtagctcacacctgtaatcccagcgatttgggaggcagaggcgggcggatcacctaaggtcaggagttcaagaccagcctgaccaacatggtgaaacccctgtctctactaaaaatacagaattacctgggtatggtggcgcatgcctgtaatcccagctactcaggaaactgaggaataaattgcttgaacctgggaggcggaggttgcagtaagccaagatcacgccattgcactccagcctgggcaacaagagcaaaactccgtctcaaaaaaaaaaaaaaaagatttgatggattcattcctggaaaccagtggctcatcataaattagattaaatttctctaactggaatagaaagtgtggtatgggtttttagtatttagaaagtagcaaatgaggaacaggaacttttttttttttgtaatatatgatcctggagaaaatgcaaatgggtgtatttgccaatgtttcctaaggcaattcttgaaaatctactcttttaagtctgtgggcttgccttgacatttgtaaaggcactttcactcttgccctaactccatgaaatatcattagcctgtgtgacttgaagccaggatctggttttctctgcccagcccctctctgtcttaccatgtgaccaagggtaaatgaattagctgctctaagcttcagttacccttctgggaagcaaggatattaataatcacagaggtgtttcggcatgcttcatattgggcacatgctttgaggtcattggatgaaaggtgtttgcatgatggcagagcaggcttattatagggtcttgagcaggtgttcctttttaatgagctttgctctcttataacatacagtgccctttggtgccccattgccttactgactgtaattaccattaacccaacatttgtattattggccctctcggctttttggaaaaaaaattaaacagttttgtactgtgtggtaagttgaggtacaaataagaggactctagcatcttacagggtggtgaaaaatagcttcaaaaagaaacgttagttgaaaagggctatagagatcagtgagttattcaaagctcctccaaaagatgaaaaagaataaagcaaacttctgtgtgtgtgcgcatgcacgttttaagggagaaagttttcagtaatatttgcttgtgacacatactgatgatagccagtaactgaaacccagccattgtagtgttttatacacagctggattttattaatgatggaatatttatgcttgctgtacaattcgtggctcatttccatgtgtatgtcagaacttaaatacccccaaaagaaacattaagataacatgaaatataaatgtggccaagctagaaagggtggatttggtggagagtctcccttcttcttattggtgtcacatcagatcacaataactgtgccgcccccctatcaaccttaggcattgatactgatctttttttccccttatatataccccatagcaaacttcacatttcaatctttttgatatggacaaacgatctgctctcctctttataatgcagataaaactgatgtatgtgttttttaagagcatattttccctgcacatgcttctcattatccgagaggcctggactcaatcagtaaaggagcagagaaaccacataattgaaaggagaatgacggtggtgcatacttggaatatttgtgggaaggggattgctgacatcagaaaatgtagtggcctgagtgttaacagcattgaagagaaatcagctttctgtgtttctgtgtattgaaaattatttttaagggaataaaaatatgggccaggtttgacatccttttatgaagttgccctggaaactttgatgaagattgttaaagaatagctcaattaaaaccttccccattaggaagctaattagtacatcccttactcattttggttgttttcaaggggcatgtatttgcattgaattagtgacatttgttccatgtgatagcaaactaagataaaaatcacagatggggaaaattatttagattgcctgttttgaagaaacctaattcctctttattacatttagattttcagttcagagttttgttttactatgtttatatacaatgatcacattttagtgtggtagccagttttgctttctggatcatgggctataaaccaaagcttatttgaatttcccgtatgaattagggaaatagaacaaatgacaacaaaccattttattaaggtaagatttcatttttttcttctacaattagtttctctttggtctatgtgtgtgtgcctgagagagagagtaggggaggcagattgtttttttaaaaagcaaacagtttttgaagctaagaaaattttgatgaccccccccccccctttactcccaggaacattctgtctgcctcaggctgggaccagttgggctttggttaggggaacatgatgaattttctgacctggtgctttctgtgaccaggctaagtggttctcccttggaagcctgaaggaaagaggttatggtgagaacaggagtgcaagatttctagcaggttctttttactgtactccacctttttttaggggggtgagtacttgcttctgagattttagggccatttgcagtagagtcaatgctttatagccaaatgtaaaatatgggccagttgtggccctcctttccccgcatcactttaggtgacggtcattctgtacctaggttcccatatgctgtgcccacggtgtaggtgtatgcctgcagtagtttgtgcaaataagaaagttagctgggttatatgatttgtggtttaatctcaccttagtccttcttgggaaggcagggtttagattcagttctgcagtggcacctcaggcaaggcaggttccctgtgcttgcaaggcaacagcaggaggaggaggggctgccttctgccttcagagagtgactcaggccctttggtatgaagatatgaaatgctggctcctgtccatacacctgctggatgccacacctgcagtcagcacctgagccccactcagacacaaaaaccagactgaaggcagatggggctcccttgaaaaggggcacagcgaaacagggagctctcaattatgttagtagagccccactgggaactgggtttagtcatcccagtgttggcgtggggaaacagattactttcttttagatgcagctcactcacttgctcaagatactgttagagtgtttcaggagtttgctttcctaatgaatttctcttgtgaactgtcctcttaaaaactggaggggcaattctgtggagggttatgtcttagaaccaagcacagggcaggaagtcgcaagacctgggttccaatgctggccctaccaatgggcaacagtgaaattctggtccaattagttatgattagctatctgttctggacttgagcttccctctccagttctaaaatggaattaatcacatctgcctttatttccccacagagctgctaagaaggacaaataagatagcagagtgaaagagcttttgtctccttagaaggaaggctgagaaactaaaggtaataataacattattattattgttattccatgtctttctttgttttcttctcctgctgtggcctctagcaaagttttggggaagttatcattcactcagtatgcaactattaagcacattttatgtaccagttaatgttttaggtattgggatgcatacaatgaaaaatcacgcaccccgcccatgccctctaagatcttacagtctagcaacttccctttccatttctggctcaacccgtaatagtgattgctaccagggcactcagaagcttaaaaggtgagagttaacttctttttttctctccacactacagctggggatttctgtccctggagctgtgtattgcaaggtctagcttggagatatatgggaggaaaggccatcgggataaataaaggaatttctttccctcccacatttgcaaagtacctaacccttgaatgatctttttttttttttccccagaagtccatgtttagtttcatcctgggttctgttctgttcctagtcaatatggtccagccctctcttatgaccttagctgtcatccatatgctaatgactcccaaagatatatctcaacctatctttgatgtcaaattggtcatcacactccatgtcttctactcagcttataggtttttgatattttcctcctcttgggagctttttcaggtagcccagggttttttgcagagccctatgtgttgccggagctattagctcatacctctgttttcccgttgaattgggcctcctctgcctgactgggagctcctcaagtactgggctctctttttatttatttatttatttatttatttatttatttatttatttattgccaccctaggccttacctagcacaatgtctggctacagtaagtgctcagtaaaagtttatggaaaatttgctgtgataagtgtcatcatagagaattcattttccatgttgagcagagttgaggtcaggaatagatggagagggattagggaaaaatcttcaaagagaagatggacagcagaactgccttattttgagagttctggctaagaagtcacggaaggaatgcctgttgtgtccactgttgttaaaccaggggcatctctgacctattgcctcccctgctttaggaccggatgatttttatggtcaggtctgcaaatcaacctctgtctataatacattgaccatttaagacaggtgtcacttagtcatctagtattaaacagggctgaccttaaatgtgccaccttaactgaggctgaaaatagagctacacacacaggctcattgatcatgcctgcttagttctatacagcaaaatgtcccttaagatatattgaagattgggatctaaaaactgacaaattcaattctcagaatgtaagcaggttgggtcacaagaactgaatgtcttcaagctgactgtcagatctttccaagggcaaaaatgaaagatgatataagctattacaggccatgaacctgttttcacccacctgatgcttttactaattagcttcttggctgggtggcaatttggggcaagtgcatgcaagctggattcacaggggagcccgcattccactctgccatttcgcaagccactgggatactacactgcttctcttggcttctttccctcccaggagccctgctctgccctggtggaaaaatgagagcgggagaatttttcattaaatgagggagggatttcatgggactctggtgttttgctaattttattttttagtgggttgtctaaaaacatttatgcttcttgacccatcagtttcacttctgggattctatcatgaagaaacaatctacaatattgaaaaaggttaaatcacaaagatgtttttgtaacattatttagattagcataaaattggaagcaatttacatgtcttaataattgaagaatgggtaagtgaatgctgatacacttgtttaatgcactattatgcagccattacgatgttatgaagttatgccacaacatggaaaaagtatttatggtgaggtgaaatgcaggatccaaaattacatcttattaataattcattgcttgtaaaaacccaaatacacataggaaaactaaaggaaatataatgttaacagtgcttaagttgaggtgcttggattataagtgatttttttctttattaaaaataaatgcatgctgtgcttatattacttgtaaaataaaatataagtagatatgaaaatgggtggtctggcattggcggttaaagattggtcaagcaggcagcttctaggtatattcttaaacttttctcattttaggctccatctaattacagggactctttatacttttctcgagataataaagaaggggatgtgatggtgtggtctactcctcttttggaatggatgtgtgtgctgggagatagagggaggtggcaacaggattctccttgctacccagtatgtcactgctcacatccacttcagggttgatcacctttgttgcctataaacatgtttaaggtaattgcttcagagcaaagcaaagtcaaactgggaccaaaaacgaccaagaccttgagttaccatcccagaaacggatctctcacactgatcctcagtaagatttggaaatgccaaggccttgctgtggttcttaaaataatttttcaacctaatctaatagggtgttcaaaaataattgtgatgtttgcaatagagtgtattaagctgtccttgcattgctataaagaagtaccggagacagggtaatttataaagaaaagagttttaatgggctcacagttctgcaggctttatgggaagcatggtgcgaacatctacttggctttggggcgggggcctcaggaagcttgcaatcatggcagaaggcgatgggggagcaggcacatcacatggcaaaagcgagagcaagagacaacgggggaagatgccacacatttttaaacaaccagatctcatgagaactcactatcagaacagcaccaagaagatctgcccccatgatccaatcacctcccaccaaacctcacaattcaacatgagatttgggcagggacacacatccaaactatatcatagaggtagagataggaacaaagaagagttggggctgactcttctcttaagccttttcttgaactagtgctagagttaggtaagagcaaatgccaagctggtatgatattgaacagacctggaacagggggcctggaaacatccatctgtggaggttcatgttgctgttcaatccacctcacatcttagcctaaaaagcgaatttgcaaagcctttctatagtagtacttctagctaaacacttcccccttactgccttgaattttccttccttccattaacattttacttccaatggaactggaaaatcagtggtagcgttaaagcaggtttatagtcttttaaaatcagggtcaattctatgtaataaatagttattaagcatctcctttgtacaagcaaataatgctagataatatgttgtagtggaagggctcttgccctaggcgttataaaaactttcattttggtcctggctctctcttaccctttgaggccctggcatcttcatctatacaagaagagggtgggaccactaggtggtctccctttccagttctggctttcaatgatctaaggacccctgtgtagtagactgagttgcaaataaagtttttttgtttttgtttttcaaaaaaacaacctttcttcataaaattgctgtacacttctaaaaaaaaaaaaggctactttgaaataacaattatagtaatagcttacttttattgaggccttactatgtgccaggctccatgcttagcactttacatggattaattcccttaatctttataacaaccctatctagtatgaacaccattatccctattttgcagatgatgaaattgagacttgggagatcaagagacatgtacaaggtctgttagtaagccatacatccaggatttaaacttgggcagtgtgactctaggcccagactctgtgccacggtgtttatgatgcctatccattgagataacctgcaaaaggaccattgtttttcacatcctaaatgaagtgaattggtatcttgggttgcaagactgttgggaaagttattctctagggtactttggctacaatatggaccaacctgagagaacataagaatttactggggcctcactttttgtgagaggttatgtgtgtgtgtgtgtttgcacaaatacatacacataggtacagggaaaactttgaactggcccccttccatttatctgggagtcaaattggatgaaacaagttgaccaagatttagcagagaaacagctttcttagacttagattctttatcctggttggtagaatgagaggtaggggcagaatgtgggagggtttagaagaggggatagaaagaagatcttataggcatattgcaaaatttatttgaagggtgggagtttggtctgtcctgaccaccttgtaatgttgattttctgggacttgtcttgggaaacattaatgtgttttggctcaacctcacaggtgtattgggagaggccaatgactgcaaatggagtaagaatttagcttggccttgcttccctgttgttgttacagaagagttgattatatagattcaaattgcatttttaaagacagaaccgcaattattctttttttcctatcaaatattctcagagacagtctgtgtgcccaggacaaacaaggttattttattgattgaagatgatgtcagacccctggcagtggcatgattaaagctacagggagattaaaggttatagtgttcatactgttttagttcttgtgcatgaaacaaggagtcttttcctttcctttctcaaataaatggagtagtgttttcctcattatgtgactcttgacatgtagatgaacataagttctttaagaaaaaaatagtaaactggagaggactctgcaaagcttttttcttaggctgatttcttttttaaacaagagacaaagatggcaggaggagggtgagagggtaggggaacgatctgtgtccagttaacataaagtgatttgggttttgaaaaggatatggaggggcctagcgtggtggctcacgcctgtaatcccaacaccttgggagaccgaggcaggcagatccctgaggtcaggagttcaagaccagcctggccaacatggcaaaaccctgtctctactaaaaatatgaaaatcagccaggcatggtgacacgtgcctgtaatcctggctacatgggaggctgaggcaggagaatcacttgaacctgggaggcagaggttgcagtgagccgagatcccaccactgcactccagcctgggtgacagagcaagactccatctcaaaaatagataaataaataagaaaaggatacagaggacagaattgagagaagagagtaagaccttgcacgagaaaagttttctcaatgaagagctgagtatcaggagaaagtcagtaatatcagcatgaagaatctaagtagtactggaaaaaaatcatatggtagtttctctccagggactcgcgtttaaaagccttgggctgttttctggtgtttcagttggaaaaaaaaggatgagtgttttgttcagaattggacaatagaagcacggtggttatgtaccatagctctgttaacagtccagctttgattccaattagaagttgttcctctgcttcaaaattaggggagataccctaaaataattaccttgcagatttgagatgattttgcttttgatcatgattatatgttgtgccaaaacaagatggaaagacacatttccgtgtttgttcactctatatctgttcactttatttttggcaacattgcaaggaaataatgttaaattaatcactttgtggttttgtggagtttttaaaaacttgaatgttttgaacatgctctcaaaatacagagatgtttgtgtacttcttttgcattgctttcctcctctcatggagtcactggtgtggattaagcctttcctttaagtgatatgaatgaatcatacataggccaggatagaagataggaatgtggttcatgtgcatgtcacttaaactcctgagtcttagaatcattttgattaggctgacaaggctttgcagagagtccaggcagaaattagacataaggactatctcaaatccaggtctattattcatttgcatccagtctatataatgtaagtctatgagttttttttactgagacactggggcagtggaagtgccaagaaagcaagtggaggcatcttctgcttggagaagggttgcgctctgtgttgggaagggcagtctactttcctactccaagaatggatggaccattgatcagatgatcagagtgtaagctccatgagggcaggaattatattttatgtgtctttgtagcccttattgtgtctagtatgaggctgacaaatgtgtggaatagttgatacacaataaatacttaatgacttggttgaaaagaaggttcttcccctcccctccacctatctgagcttgaggcactcaaattgggagcctcactgagtgttctttttttgaccaaaaacctaccttatgatgactgccctcccttctgggatgtgggacagtgagcctcactaacctcccctgctactaatagcagtttaaagtttgcaccctaaaggtgacagtggttttggcttttgtcatcatccaccattccaacttggaatggaagtggtagctttctagggctgtgaggtcagaacagagcaagtctcagacctgaacatttccatcactggagactggcctggccttccggacacagctactggacactgaggtttcttttctgccctagtggagatggactctgctactcatttaaaagccaagcaccataggaggacaagtcattctcttggaagaactggtttgattaactgctggccattggtggcaaaatagaaacgacgtttttatttctccctccctccctctcctgaacatttcagagtgaccagtggttggactcttggcggcgcttaccctgaacctgagtgttaggggagagggaatctgccgttgcggtttctggagctgctcataagcaagaattccctatcctgatcaaggctttaagcctaaaagaaagcagaaataggtatggaatatttctgtgtgtgtgtgtgtgtgtgtgcacacgctcgtgcatgtgtgtatgcatgtgtgcctgtgtgcatgctgggtggggtgggtgtgacgtgggagggggtggtatacttttcagggtccagggcagctcagtgtctgcatttccctgccttacagggagggtttgtaaatcacttttgctttaacaccatacttgttcctgtttccagtttgtgagcagggaaaagtaatttggtagtcatctctctagttttgggcaccaaaaaggatttatatattatgcttgtcagcctatcagaatatcccaatttgacagttcaagtacaggagtcctggaggcacattgggaggaatggaaaagggactgggttgcttaacccactggtgtgcacttcccaagagaatatgatgagagggactttggagggtcccttcgtgttgtcagactgcccagcgcaacagttggaagccaggtagcagtaaccaacaagacgtgaagaaagagagaagatgaactttcttcatatactatatgtacattctgggtcactctctctctgcatgaccaaaagaaaggggttcgtgtttccagagagattgcaggccacttaatatcatagaaataagagcctgggagccagggatccagagttgccatctagaaacctgatgctggttaaactgacctttattgtgacttttcgtgtgacattatgttcattctccaccaattactgaagatccttagagtgaaagtttcattattgaacattattacttaattccaatacttaacattgacagattctgcccaaagaatttttgaatctctaatgaattagtgtgtactatacagtgctgagagagagaaatcacctaccagccattttttgttgagaaaatagacatcaagaaaagaggaatcagttgtataccctgtaaaccaatagtatgattagaatttgaatattaaattgtgttactaaaatcagtttcagtcaacccatagtacctgttcagaagaattgatggtgagggaggggatatgctaatcgtataccctttccagaaggatgatctttatatttttcaatttctaaattttgtcagaggcacacttcaaataaaagaggcttcccctttaagcttctacccaataacaataacagcaaatctaaatgactgtttctggagagctgaaaggcaactttgtcagtaataagtattccaagtccttctcttattaagccaaggagcatccaaaatggagactatgaaaatgattttttaaaaagatgtttcagagccttatgagatcagagaaaaagatttgcatcgaggcagggatcattactgtctggtgcaagccaagctctcttcaccttttatttatttgagtctttattttgcattttgtagctgccttcatatgctgagctgctttacaaatcctgttatggggtaactttccccactgtcctgcccccacctccacagccataagatttgggtttttgctttaaatagaatacagagagatgaagcctgtgaatatggaccttgaaaagttaccccctttgattaccctagttgactgttccaggtttctcaagcattcttaggagttaagtccagattgaatatttaactcatgctaaaagtgaaagagaaaacctagagctcttatgcctccatgttcttcatcatatcagtgctagggcctggaatccccaacaatctattaattttagagtcaattctctactttgtttctgcaatcgaatcctcaccctccaatatccattttctttccctttagaggactgatttatccatcaactgggtgttaagcttcctgtttccccttcccaggtcaagggcagcccaggtgcccaatttctctctctcttcacaaggcaccaccagcaatagagatgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggtaagagagttctgtttctgtcatttcctgacctcatccccaaccagcttctgctgtgtgttgggaatcttagggaaggaacgggcaggtgtttgatataacaaactctgcaatgcatgacaggcctctggcttcgtgaattgcctgccaacccgaatttgtatcctctttagccataattagcactgtattaacaatcccttagctttgtaggttgagcatggcctcaactgcctagtggacgaacaggagcaaaagtcttgttttcagcagctatttgctgtcctctctcctaggatgttgaaggggtctgtgtttctcataagccctccttgagaggtagaagcaaattaccttgcactttaattagtctggaacatcctatcacttgcacatattcccctccatgaagctttcatcatttatttttgcaaacaaatctgtgtatttcttgtcagttaccatttttccatagaattaccattattcttttggactaaacaaacacccagatgttatggtgggggagctatgtatgtatgtaggttcagaatgttacttgccttatgcttgcagtttatgaaatctggactgttgtatcttttttttgtagagaatttattagttgcctgtcacatttttaaacctctgagttaaattcccatcacatcatatagaaattttggtcagatgctaaaatacagaaggaaaaatattaccatttctgtcttatatatttagttgttcctatatatacttcttaattattcagaggtccattgtcccactgctatattcactagaccttatgattctatgattctgttcattgttcctgttgttagtatttgggccatgtctctgatcagtagtatttccacatatagggcaggagaaaaggtttaaaccatggggaccgatggtggcatttaagtgtggtatcctgcctcatggccatgagtaatgatgggtgaccatcaggtttgaagtgcttggtcctaggctggccttcatttatatgcggctcacagactaggtctgtgatgtcctttgatgtctacctctttgtctcctgtaccctacttgctcattttggaaaaaaccttctggcttgaagttcattgagtgactcaggagagaaggcagtcatggggtggagtagggtgaaagtgagagaaggcacctagcatttcctggtatttcttttttttcccctgcaggtcctgtttttgtagccagaggcaattcactttggactccacctctaactttgccagtttaggatttttttttttttttccctcttaacccaggttgatttcctaacccttttcaacctcctctgtgcagctttcaaagggcaggagcctatgttctgatcagtgtcttggaacaggaaatggggtaaccaacaaggctactcaggtttaaaagagatcaagaaccagattcccatctgaccaatgaaacagaagacccagggaggggttggtctgttcaagactgcctcacttagtggaaacccattcaagccagcaaaatatcaatgaagctgggggtttttattttgcttttcccatcagtatggaagagtctgttgatgggctgatgtctgttgccttgtgggaggggagtgtgttggctggggtgtggagcagaagccacagccccactcagcacacagcccgccttcccaggaaagctattttcagaactcattcaccagtattgtttgtgatctgaaatgactcccacagtgtttgaagctagatggaaaattatctgccctttgatctgcctaaataaataatgaggagcccaaagaggttttctttttttttccttttcttcccatcctgattaaaccaccggagaaatttagctgcatgtattttacaggaagatacatattttttatcctcccacctaagttatctgtggatttctctttctttctgtcctcaaaagcaacagagcccatgatgatctacccttgttgagcagcattttaatacacagttttgctgtaacaggtttttctctatgggaaaggagcagagtgcttgataatgcttgatgaataagcaaacctaaaatggccctagtgggaggatgctccatatgaaatttgggtctgcatcaggcaaatactggccgtaaaattgttgcagggccctacatgagggagtggcacctattgacaaattactggcaaaaggaggtagttgaactgctttccagaagtgtactgctttaaggtggtgacacattttccctcctttatttcctttaaccaactagctatacagtttgtgagtacctttccaagtaactgctgctagcagcaaccaattagaagactacattctgagcccttaatccacaaattacaagtcaggatgcaaagcaaactctttgaacaaattgctgttaagaaaacatttgcttgcttttcgaggtgcagtgaactgctggagatttgctgttaaaatgaacaaaattataaacaatccttttattacttcatctttcttatgccctcctccccttaaaaaataaataccttgaatgcccagaaccccagatgagaaacaaggcaaaggctatctgaataattttaaaatttcagaatctttgtctttctaagtgctgaaccttttctgcatcctgggtttatacatttatcaactgcttttaaaaattaaatcatttctgtttataaagcagccacctcctttcaattgttgaaatcatgcccagatctgaggtttcttgaaatccttgtttagtggaatctaagggtgacctaactctgtagttcagagcagagctggttgtgcaagagaaaccatcaggaatttgcagcctgctccaggattcacagattcaccgattcaccattgcagagcctgggaaaggcagtttctgtggtgaggatcaatcaagttccaggctattgggtggcacctgctctggtgagagtgtgtgtgcaggattgcacatgtgtgtgccaggagtgtggagtgtgtgtgtgcatgcacatgtgtgcatgtgtgtgtggctggggagggtgagggctcccagtcatcgaggtggcagggtggaaggtgctgtgtcagctgggtagagtggcttttactttccctttgagtccttactactgtctctgggaggagtgtaccccccaccctaccccacttcccagctttggggaggatcctgattttagtcactggcctttgtcctgcatgtatgctatgtccccttttctgcagagccccagtggcccaggtagccttaggaaggagcaggatgaggggacggaagtggcaggaggcaggtcagggcttgcatggaatcatgtgattctgttgtctgcaggcggcttgttgttcctggttaacgtgtcagtggggagcgattcaggctgctgtgtgctggaaggacctggagagtgtgctgctcacatggctgccacctttattattactgtcattacttttactgttattatttaacttggggtgtattttggcttcctctgacatccgccccctccaactctcccttaccccgtcattccttaatctctttttctcacggggagcttcaccccagtgttcattccgtcctgctttcccctggtgggtggatgctggagcccagattgagttcttcactgaagggctttctctccctttgtgactgcccaagccattgctggtttgcaaaccagccagtgacgggctgccttggttttcccaacatcacggtgcactgagatctgcttccttttccagcctggggaattgaggggcagctgccttgtctctgcttatcttcatcctcagcttatctgaccccagagacctccttctggagacctcatggtctcctccttcccaaggtccctggaaggccatgtgctgttgtccagggaatgcaggggcctttcagtctccaggcaggagggaggccagtggctgagtttgtttgagagagaggcctgggttgcttgatgaggcccaggggagctgtggagagaaagcccatttcagaactgggcgttcagtctttaaaagagaatacctcccaggccttggactgcaaatcctgggaacaaaaatgaaggttaatatagtgatttttttcccttaaaatttgagagctgcattggagaacatgaaacttaagcccctcttttctgcccacaaagcagaaaagagacacacaagccccaacaaatctcaggacattatattttaactctgtaggcatgtagaaattgtaatagctctcattcaaagagaaaaaagagcacttagtcttttacctgtgaggaaactgaagatccatagaatggaaaataggagctcttcaccaaataaatgtataaataactcccaggcttttgattgaatgagtgctttgagctctggggaaaaatattatgtatggcagcaactttccagttgtacttatgagtaccatgtcaattcttctttgcccaaatagttcgcatgccctcttcaatattcagcaattatttataatgacagatgtatgtgattggaagaatgtgggtacaccagaggcatagatgggcctgagcgacagaatccagggtttgtacaggtttgaggactcttggggaagatgtaggttattgggtatccatgagaaagtgtttggaatgattttgtagctgtaaaaagcccttatagttaagatctcttgtaaagatggatacatgaacagtaatggtaactggagtgtgtgtctgaggaatgtgctttagcatctggaatgccagttaaaagttaattgctcctggtgatttgtcccagttccaccatgaattttatgcaatttattgcaaagattaaatggatatcctttaagtaacaagctaacaaggtcagcttatctcactgggaggtagagaagtgactgtaattcctattccgccaaaaatgagaagaccccagtatttttgcaatttatttgtgacctcaagaataaaatgggctcatgcagattaagtaacttgcaccaagttacacagctcgtgagcagtagaagaggtctccagactccctctgttgggatccagatcccatgcacttagccatctgtcttccctggattgagaaatatcaactgtagaacaagtgtccacaggacatgggagcatatgaggttaattgggcatgagctagggcatgaacaagctttttgtcttcagtgcacactgacagatactattcctggtagtggtgatggtggaagtgatccatccacatactaattgtttcccttaatggctaatagtcattaggtatgaattatttatacttaggtgttagcattttgtacctggtaattaggtacaaaaatgggagagccacattaaacaatgtaccaaaggtctctttctggaactttctatgagcaataggttggaaatctaagtatcagtgcacagaaatcaatgcattatggcagtagaaaaagccagaaaatgggaattgggaaagaaggattctatcttggcaccaccactctaatatttggcagatgacttcccctttctggacctcattccccatctgtccagtgatagagttgaactaaataattttcttttaaggcctttccagttcttacattttgcgattcattacatcaaaaatagtatgttagcattgcttgtaaccctcttcaagtctttttatggttactgctaatgggaatcattaaatcgttaacaactggaagcaacaataatcatttagtgtctctaatataagtatctaccaatccttgaatagttttttttctttttttttgtgaatgtatgaattactaaagggagttgcagatagcaagatgggggtggtttttatggctgtttgttgtttccatcctggcaaatggaacatagtttctaaactaggatctttatgtgtgctggaccacgtgtataatgtcagaaaaggtttaatttaaaataatgagatgaaaattaccttgtagaagaatcgtttgaaatgtttagacttgagcaaacgggtgtacaggtgtgtatcactacgattttcacaaagtgaccatggaagttgtctggttctgaccctcatgggatcacacctctgtttgtcaggcagaggcacagaaggtcaggctggaaaagggctgtggtctttgcagagatagagcaggcagggttagacttccccatagtcagaccctgcctgctcttcattttgcaggtgtcctgggggcatcagaagcctcctcatctcacttttgtgtgcccttctcccccagtgccttaggagagaaattaacccgcacctgcccttcatgttttacaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtgaggcttccgttttgggatattagggtctctaagtctttatttgtgagacttgtttaatatccacattaaagtctccagttgtgaatcccagcattacttgtggcaggtcttcaggatttttatatctgaaggttagatatgagtcaaactttggaaaaagccttctacctgtctacctaggagaagtaacgtcttacatttacacaaggagaaaaaaatttatgcagtttttccagacgctatagccctaaagaaaacgtgattaattcttttagaattccaaaaggcagtgatacttcttgataagaatactggtgatgcctttataggtaaaggatctgacggcaccttaaggctcattgtcttggtcacattttcccaaatatgaatttgaatcttaaatataaaaataaatgtagttcctagaaaaatctcaccagctaaagtttgagcagtcctgccttgttctggaaaaggctcagaatactttttcctagtgggagttctcatagtaactctctttcaacaatccctccaccccaccctttgatttggtccctccctgcagctcaaattcaacatctgctctctttctctgttgtatgtggggggcaggaggggcttaacaccacagctgggtgacaggtgacagccctaggctgaggaaatagaaaaaggagtgtatctccagttcacattcttctctgcccacccccattgggactttacctctggagtaccccaagcgaggaaccttagctcttggcttccaggggctgctggtgaatagggttatgcctttggccgcttctttgcagcttttgtcattgtggagctattgtggtttggtctccctacaatgtgaactgttcagagaggtgagggtgaaggtgggggagggacaggaggatgccttgtattgtccagcaactctgtccttaggaaacaccaggagtgaaaatttcagaggcctgaatgaagctgagtatttgtaaacagacaccaaatctgggggcctcaaggagacaggggcttattatcagcagatgattttttttctttctttctttttttttttttttgagacggagtctcgctcttgttacctagcctgcagtgcaatggcacgatctccactcactgcaacttccgcctcctgggttcaagcagttctcctgcctcagcctcctgagtagctgggattacaggcatgtgtcaccacgcctggctaattttgtatttttagtagagacggggtttctccatgttggccaggctggtctcgaactcccgacctcaggtgatccgcccgccttggtctcccaaagtgctgggattataggcgtgagccactgcgcctggcaaacagaggatttttatataggaaaatggcttccctgtcccttagttttcctaaatctggatgagggttgttggagtgctctgagaattgtttcttcccggcttttccctgattttgtattttcacccgcaaattttaactatatccctatccccatcgctttggtgaaataaattaattatatccatacactagaaacccagtctggctgattaggctaacagttgacaccccctctccaaactctctcttcatggtgatcccagcccatctttgatacaatcactgaaggatgaacccagctctaatacgggccctttttgccagaggatccatggtgattttttgtgtgtgtgggagtgggttcagccagtgacagggaagagggacagagaataggattgctgttgtttgttccccaagatgggaaaagatgcctcaaataagtgtaactggaacagcttgaatgttgggaaagtagaggctgacccagtgtcgaggtagagtagaggggaaggtggaccaggagaggaaaaggaaagtggggaaaattaaggtagatcccaggtagtgctggaggaaatgaaaaggcctgaggctcatgaggggaataagtagacagagtaagtctggaaaacccactgccaccctcctctctgcccccaccatcacccagcccaaaccagtggatatatccttctgtgatggcttttcctggaaggccctattgagagctgtgggacttgcccttttgaaggatggagtatctacacagggggtaggggaaggattagtacaagatcttgaaatagcagtctgcacaccttgaggaaagggactaccttctaggtgttgcattctgtgcacaaccggacagccttgaactataaatgctgcccagagcagaccaacaccaagcctgctctttcagatggaaatgtttattttctctccccagcgcttgagtttcatgcaaaagcttcatcaggcgcaggccttgcagatcttgtctctaaatgccattcaccagttttcaccttctgtgctgctatcttggtgccatctgtgaagagaaaaacacttttgagtctgctcttttctgtggcataagccttatttgtttgcaggcagtcctgtctctggcagaattttggagatggaggcgggttgaatctgactggtttggcaaccttacctttcccctagtgtcccattaggggcctgatatttcttccctgaaagtaccctgagctttgttaaacaggatagtggaaaacacagaagcaatgcagaatggttgcagagtccaatttaatctgaaaattgcttaatagaccgtgggtttatttgtcttatacaaattatatgcaaatatctgtgtggctattatatgtgcaatggagctatactagttacagaaaaactctggagtctaatttctcattttcggcctgattgtggctgattcaggggaagaccctttctctctgagtttattttccccattttatgagatttgcaggggtgtcataaaacacaactctgattatgattttgtgttcaaaaacctatactggtttcccattgactatgggataaagtccaaatgcctggcattaaaagcattttatgatctgactccaatctatcttagcagccatatctcgccaggttccctctgcgtaccccacagtgtccagccaaattaaacgactggtcattctgggaatgcatttgcttactcagaatagaatacccttcccctcacctctgctcattgaaatctgacccagctttcaggatctgactgtaaatgccacctcttctcagaaattgttctcctccccacttccccaaccaggaataacttcttccttgtctgtactttatggcactacttctacttttcttaaagatgtatcttgccctatagtctttcattcgattggattgaaacctccctgagggcagtgagaatgttctcattcatatttacacacccccaatagtactttaaagagttcgtgtaaatatttggcccttggtaaatgtttgttaaattgaactgaactacttcatgaagcttggggtttttagggttggtctctgctgctgacagttgatcttcagaggcaatttgacttttctctctactaaaatgagaagaggtatcctgtctaggcagataatcagtgcagactggaaccaacatgtgaaagccctttgaatgctttggaatatctacatactatatatattattactaatattttcaaaattaagagttttcttcagaaattaaaatcctttataactatttataaaatttattctatcttaccatctcctctgaaggcagaaattgtctatttttttaacccgaggaaagaccatgacaccatgagttaattactaagcttatggttgaaggtggagatcctttcttgaaacttgtgtcatctgactgtgttatgcttgcctcctggccatctgtgagccctgggagaagctgtcagcgaggatttgcctgtttgttttcagaccattttccccatcaccctcctaccatcaccaccattgtctttttttgttgttaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagaggtgagggaaccaacagacttgtctttgtacttctgaagcagctgcagggtggtgaagggaagggctgagcaggatccaactaggctctttggggttgtccaacccaccggtatgggcagtaaatggctgggcatgtgccaggctaattttttgtgactgcaatagtcctcagtcccaagcttgattgatcaaagtgtggatgtacctcactggtcttctgagcaatgagctgatgtgttaatcaggcaggatccctgctgggactcctggacccacctggcccacccccacaataggtgctgcctcttctttttaacaggttttacagaggcgtgccctttgactgcaagcttgaagtataatgtcctctcttatttccaggactgactgactccttttatttttgactttcacctgataatattgaagactttgggaaatatttctactttaaagtgccttcagcaccttcaaaactgctaaccttggggatggtactttcttttttttttcctttttcttttcttttttttttctttgagttggagtcttgcactgtcgcccaggctggagagcactggcataatctcggctcactgcaacctccacctcccaggttcaagtgattctcctgcctcagcctcctgagtagctggctgggattaccagcgtgcgccaccatgcctggctaatttttgtatttgtagagatggggttttgccacgttggccatgctggtcttaaactcctgacctcaggtgatccacccaccgtggcctcccaaagtgctgggattacaggcatgagtcactgtgcccggccagggatgttactatctttgaattttggttattttatctttaaagtcagggggcccaaatacatgctgctagttgtccctttcaactttgacattacatgagtttaaatactttataataactgtgatactcttttttttctggttaatgaaagatatctttatatatttggggatggataatttcattgaaatttagaattctgcacttaacttaggttttggcagtgaggagtgaaagcattaaatacttacctcctcctccccggccatggtctagtattattttgggattcacatttgcaaactcatgttagtcacccattcctgtttaacaagaagaaacaggcttgttttaccaaaggtcagtatttagagggccaatagtatgtgcatgaaagtttacatttgagaccctgttgattgtctccaaatttcacagagcgtctagagactgccaacaagcagcttgcagagaaggaatatgaggggtcagaggacaccagaaaaaccatctcgcagctctttgcaaaaagtaagtctgcaagctgcagaaacaggtattaacgtgtggatgggagcaaggtgcgtgaaaagattacactgttctctttagccttttagaacagccagggcagagtcaatatcacctaaggattgtttttcctattcaggcatgaagttggaagattctgttcttttcctcctaagccaagaaggctgcttgccacaacatctcgtcacatcacattggtccttcagcattaaactagagaagccccttgaaatccctgctagtgtcattgctatctaaataaagaggcttactgaacatgaggtcccttcatgttgaagggattttcttagaagaaactgtgtgttggctctggtagagatgggattaatatgcaggatcgatgatagtgtttggaatacttcacctgtacctggggctccctagtatttattgttacacagcagcagattgcaaggggagctaatcctatggcctgaactagtgactctggctgcagagttggaggatgtgggggagggcagagctgtgtcttcctcataatagtgtttcctttgtctggaaatactcctaggaccatgacaatgaattaatccttttctttatcagtgtctaatggaccccacccagctagacaatgtctaattatttccaattgccttaataaaaccagcaataaaaacttcatagtggattgagtccacagggagaattagtcggggggaaacatgaactgctctcatttctgcagatgccggtagctagtttcctctacccccagtctccctcagtgtagctctggctgtagttgtgctcagtagggatttgccattctcttccatctttgctaggtctccaaatgaccctttcagctcattccatgcagcttctagccagcttttacaagttcgtttgatcttcacttacaatactgccctcccttcctgggttgttctgttgtgctctggtttcagaacaggttttttctttttcttttccctgtacctcctgttcctttgtcagcatatcttagagtaaggaatgtagtttttctggtgtcatcagtgcctagtataaatttttgtgaaattgcttttgtggtatcacagttgctctcagagctagttcactggcagaaagagggtggcagactctcagatcaaaacaaaacaaaatgtatagattctttgttctggatcagctagatcatactcctttctgtgtggagatggtatttcaggtgtcctaggagctctttacaggtttataaaatgtggtaacttagtaaatcagacggtattaccggcagggcaaaagactgtcaaatggctctaggaaggaaaagtgaagttcatcaactagccagggaagagggcatgactcttgtccctcctaatttctttcgtcttgggacactgacagggtcctgtatggttggaactgtggcaggagaaaggaaagccctctcaaaaagcgtctctggggaatgtactgcaggaatcctagagaaaccaaaccaactcaaccctagaagaaggcagcccggtatagtagaaccaatctgggtgtaaataagggctccactacttatttaccaactgtgggaccttgtacaagttagtcaagctgtctgggtctctgttttctcatatgcaaattggagaggagaatagtaccttccttgtatggttgttctgaggattaagctagtacaatacctggtatgcaatacgtattcaacgaatgttcctttctttccaaatgcaaagtcagagtgggaaagaaggtgagactgccctattgaagtttctcctataacttaaggtttaagtctccagatgaagagcacttaacctccaaaaaatcgaaactacttgtttgagtttctggtgtgaggtctgtcttagttaagaggagaggaaagacaagggacataactacatgtgtcatggtcccctgtagttataatgatttgattcagaaacatggaattgctgattttataggtcaggtgactctcaactttctcatactaaaaattagtgtacagaatctgttgtatcacaatgaaaggttttgaagctacagattctcattactaatcgtggtgatgatgatcatcatctgctttatgtagtaagttcctttggtgtttggttatgctttctaacatttctttcacttaaataaatcttctatctcatttgatccttacaaatattgtgaggttaaataagatggtattgttacctctgttttaccatctagcattgttgattctttcttaacatgtctttctttctgcttatattattgatctgatcttgcatgctgtctactttttttattagagccgttagcatatgaatcatatttgttttaaattcccagtctgttaattccagcatccctgccttatctcggggtctggttctgattcttgccctgtcttttcaaactgtatattttaccttttagtgtgacttgtaggttttttcgtgtgtgtgtgtgaaatggcagacctgatgtatggggtaaaaggcaactgtggtaaataggcctttcaggatgtgatagtaaaatctgggggaaagggaagtgctctagacctatgattaggtctcagtcttttagtgagcctgtgcctctggactgaacttcacaagtgcatctcagttttttttcacccctttaggtggtgcaggatcactagaaagggcttcagctggttatttccttctctcgtgtggaaggccagagcagactggagttggatgtttcctttcccgtgggtcggttaggctctggaaacaaacaagcaagcaaacaaaatcccaaaaactcatagattaggttctggttaaatagtttctcttgagggcaggccttgttaagaacagaatgctctggcatatttcataatggttcctttttccctctccctgctggagtcacaaggggtccatttcacaaatagacatctacaactaggaccaagcaatgaaatctttaagtgattatttgggaagagtgagaattacttcgttggaattcagtgatatcacttcaggtgtaatattctgatattctcattagctgtgggtactggaacaaggtacagccagccactagaagagggcagattgagataagaatagtgtatggaccaaagtgtaaaatctgtttagggattacttataaatctgtattaacttatgcaaatgctagcttgtgatcatgttccttcattctcctaaaaattatagttttggctactgtctcatactggtgctttcttcctctatttttcttatatccatccacagatgtttattaaacgctcattatataggtgctgctaaactgagctctctttaaaacccaagccagaaagaccattatctgcccactaagctcttccattctaaggtcatagagtatatttgtatacacatatgcacacacatgcaagtatttatatacacacatacgtttttgtatatatgcaagtatatatatatatatatacacacacgttttatacatatgtatatatacatatgtataaaacgtgtgtgtgtaagcacacaagcatattggattacttttttttaattttaatttttttgagatggagtcttgctctgtcaccaggctggagtgcagtggtgctatctcggcttactgcaacctctgcctcccgggttcagcctcagcctcctgcctcagtctcccgaatagctgggattacagtcgtgtgccaccacgcccagctaatttttgtgtttttagtagagacagcgtttcaccatgttggccaggatggtctctatctcttgacctcgtgatccgcccaccgcagcctcccaaagtactgggattacaggcatgagccaccgtgcccagccatattggattactttatttaaaaaaaactgaactttcaaactctaataggcttaaagggagaaaaggagattcacaaatagaggatgttttcttcaggtgaaatggctgcctttcttcctctgatcctgatgttttccatctaactttgccctgttctttacagtgttccctccacgcctagcctatcctactggagaaggagtaggataaaagcataacatggcttccagttttagtgtattatcttttaaaagacattggattcccaagagaagcagatgctgagataaagtgggttgggttagggggtggtgttgggttaggttttccgtggagaggacatgttgtcgagtagacttgatctcagttacaaagtgatgttagtgtgtgaagggtgggcatgagcttttatccagtttatgaaatgtcatttttagcactatttaatgtactgtcatgaggaaacaattggaaaaatgttttgagctcaattgctttttgccaatgtaagacaatttggaagaaataaaattgaggagatgagcctaccttttcttctgagggctctgtgtgtgtgtgtgtgtgtgtgtgtgtgtgtgtgtgtgtgtgtgtgtattctttgtataatgcctaataatttttggaacacgttacaactattttctcattgcttctgctcaacaaccattaagttgttaagtgacttttctgaatttctacaacaagttagtgagagagccagtgatagagtccagatcttgggtatactggttcttcagctgtgcactagagcagtaggctatctagtaaagggtatgatgtgtcaattttgctcaggtaaggctttgagctagctccaggctggcagtgttgatgtttaatgtcctgacagataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagaggtatggtttcctcaggtagcatatgagcctgggggtgggagggctgggaaatcggggacactgggctccacattgtggtgaattggcagctgcataatccccagaagggaggtgccatctgctgctcctagtttccactgtgctgatgtgagtggactttgctttcttttctcttcttggtaaattcttttcttttgctccaaaataggaaatcaccagggtcaagaaacagtttccatttgttcattcatataataagctcactgcccccatattccaagctcttactatatacctagccgtaccataagcctatgacagatatataaatatatatatggacatagatgtatagatatgtatatgtatagatgtatattttaatttctgcccttacaggtattttaaaactttataaaactagaaaatacttctaggtagcttaaagtactctaaggattttgaaatctgaacagcccttgtctacccaggcttagtgggaagtcagtcccctctcaggtcagaaatgattcttgctggccatatcttttactgttggacttacttggcagattggtttttgaatagaagcaatcttgggaggtctgagacaggatgggacccagggacagtttacagcttatttcagaaaaaatgctctggccaaaagctgtgctgtggttctcagtggctacttctagaaaatagttacgtggaggaatggacttgtcatttatgtgtgtgcagagatgaagccttcccttgacaaatgcaagggcccccaaactattaagcatatgattaatatgtatctgattaggcttgacatagatgctatttgattgcaacactaaactgtactcatgtgaaatagagggaaatttgctgctggcttgtcattaatttatcttggatgtcagttgttattgcactggactactaactcttagatgttttgcccttcaggggatgggtgtgttccagcaaaaattgatgctagagtgtatcttggtaaagaaaatttcatatctcacagacttctgctctgaaatttgaattgttttaaggggaaaaatagccttcatcataaaaagttgagaaatttgtagatttgaaacaaaagaaatttattagcatttaaaaagcattctggctattgtatatgaggtatctttactgccttcattcattgcttgcttcctttccctcaataagaataggtctagttcctggagatttcccaacttatcaatttcctctgctttcttttttggatattaaaatgcttgttggagttgggctgtaaattcacactttaccagtgggtagtgccatctaattcatgatatcccttagcctgacttgctagaatatcaactccaggtagtataaaatcaggttaatatctagcttcatcagttgtctatattagaactatgctaagttgctcaacagaaaatgaggaagacttgtacttacctgatgtctaggtttaaggagcttattgcatccttttgctacaccccatatattcccttccctcacatttttgtgaggacattccagagaaaattacaggatggggtaagactgaattcttttagagaaggacaagctaagagacctgctgcgaagaagtagcttgctggtggtcacatggccagtcttgggtagagccagaaataaaactggtatctcatgactcttcattccctaaaccctgctgcctttctccctgtctgaatcatcctttggttcacctcccaaaaagaaaatgtgggtgcttgttcagatttagtaacctctgcatcttttaagttttttaaaaatttcttcactcgtcgggcctttcttttcaaaagactatgagaaacttgtccagactgctttgagattggggtgtacagagagtcctgctgcccctccaggaagggtgctcagccagttggagataaatggggacagactgtctgcaaccatttttctttgcaacatccgagggcacagtggtaactggttgtttgaaaatattgaaaataatatatgtgttgggagaaaatgttcatttctagttcccactgggcagccctcgctgaaaaggttgcctgaaatatatttctggcttcagacttctgaggcttttctgggcattagtcctggagatttttagtagttttccaggggccctccccaaaatatgtatgtagctttacaatataaagaagttctaagtattgagctgggattgaatgatggcatttatttcaaatgaggtcatcaattattgttaagttcttagtcctcatccaatttgtgctttcacatggagtctaattgttaggaaattctgagttgctcttgctaaaggaggtgaaacctttgactgggagagcaggcttaccaccctctacccagcggaatctcagaggccatgtgatgtcttccagactttcaagcccgctcacttctagcacatataaacgcttggaagaccacatctcagagaaaatcaactggttcttatttccctttttgttttagcagtctctcagagctggatttgctcctgggcgctgtttgtcgtgtctcctctatattgttcaaaggaaaacatcccttttgcttatcctcagatataggaaattgctaattaaagttttgctttgctgctgtgactcagtcttcattaggctttgctctttcagggctgaaatttcaaagtttggaacatcatcagggaggtatttgaggtaaacaggtagttctggaacagatctaggaaggaaccttcattgtgattgcttcacaaaatcattgaacattgctaaaccgagaaaggtattcatgaatagaagagttatccttctgtctgttggaaatggctcaagtaaggctgtttttgaaggcacatggatatgttagataacctgcctgtgtcccatataaacagataatttagtgatggcttacaaatggcatcatgaactttcctcttttctcgaaccttagaagttcttccaaggaaaacctttctagcctacttagcaaatcaaaattagggaaactttctcaaattagaccttttgtcaggagactatttttctcagccttctaactacaaggtcacttaggtaactacttctcattgcattaaggtggtcagggaaaggttatgactactttaatggtcagaggacccttgcatttatttatgtctttctctttacaaagacctcatttagatgcttttcctgaaattcattccttcttgctaatctcattaactctcttgcctgaggttctctacaatcactgtgctctaaactctacatagaaatgttgcctcaggcttacaaagaactttctcctgcaatcacagcttccatttgctcccaagttcaatgcattctttcatggacctggctctgctgacatccaggaaggaggtatcttgctggggaggggatagcactgtaattataaatcagacctgttttcttggtgagtcactctgatccaggccttgaaccagcgtgtaccctgtgcccctattgcagtagcagccgaacgaggtaaatggtgcctttccgtccttgcccttatctttctttcgggacacgtaggtcctattgaagtggaggctcattaaactccaagtcaaaagagctctgtgtcctacagcaaccacggtattctcccattcaaagacagcctccccaccccctaccaatttgacctcgctggagattttcgatggatgtctggcatatcctctcacaaggctcagggcagcccaggcttctggctggctgctgtcttatgatgatccggagtggaagcggcttgggtaattgtttcagggatggtgggaaaaaggccttggcaagatcaaagagggaagatgctgcgggtgggctgcttactgaactgagtgcacaggaagggagagtgtggaatgtgagagggctggcagagagagccagtgagccttgttctttggctttaggctagaatgaaagccatggagattcaacaagaaggggcccaaatgttaaccttttctgaactgcagtggctagtgatgatgtagatgtcacattgatagctcgtattggagtagccagtgcattttctggagtcccattgcaattctactcaattctctaaggctaaattcataccgttttactccatttccaccattgttcttaagggctaatattttcccttctttctggatctcttactaatttgatttgtctttttggttttaaagatacataattttctgctatgacacctatccacaaagcatcataaccaatttcctgcttccctgatattagaggaagatgtcataggcatagatatttatatgtctaatactccaaaataattttcaaacagcaataggatttcattggtgaaggtaaatcttacccagtgttttgatggattatagatttggatggaagatccaaggatgtgaattatgtgtgcatttagagtattgataggatacagataaaatacatatccacccaggaatcttccaaagtgttctgctggtgcattattgatttatttgaagggcatttcatctaaggatgacattctccatatttatctcagtctattttatctctttctttcttttcttttctttctttcttttgttctctttttattttttatttatttatttatttattcattgagatgcagtctcgctttgtcacccaggctggacagcagtggcctgatcttggctcactgcaacctctgcctcccgggttcaagctattctcctgcctcagcctcccaagtagctgggactacaggcatgtgccaccacgtccagctaattttttgtatttagtaagacggagtttcaccatgttggccaggctgttctcgaactcctgacttcaagtgatccacccgcctcggcctcccaaagtgctgggattacaggagtgagccaccgtgcctggccgtatttacttttaggtaggtgtttttccacccaatgtgttacaagaaagaaattatgtctacccccaaatagagatggagtgatctctctgagctcaattctttcagtctttcctatgattttggcttttggaattcctaaattggaaaccttgtgggtttctctttagtcgcctttacaacatgagccctattcctgaggtagcaagtttttagaggtggttttttttactcttcaattcttttaatatctaccagtggaccacagcctactggcaatggacagaggcagcttgctaataccagggtagtgttaccaaattgcttcagcatgaacccttacttggatccagtggctcctgggtaagactaaatcagatcaaactaaaatcaggctcttggagcaacatataaccagtggtatgaaggagaataacaataaaaatacacttcagttgtgacatttgtataagagtgtttggagttgtggacaatacaggggaagaggaaaattagacaatgaaggcactggacttagttttatatttttaaccttaatgtcctttagccaatggagtgtttgtatatgttggtggtcatccagctggtattaatagtctgtcctttctgcctactgatctgtattttcttgtttgtattttttaaacattaaaaatatttacagatatattagtatatccccaaagaaccttgcaagtgttatcctcatttgacagattaagaaattaaagtacagacagattaggtgatacagtcagtgataaatttaggagaaaacccagatctcttaaatctaaaacattttaaccctgttctttgtccactagtgaataaatgggaagctaaatgattaagtcgcttccttgcaaatggctaagacaaatggggctctagaagtaattttgtatatagccatcctttaaaaaataagtttgaaagacacccacagttgttggaaggagggaagagatgccatcacgtggtattcatttgcagggatcagattttcctgagtcagaagggggttaagagatctgccaaatacttgggaactggttcaaaatattacagaagtgtaatggaaaatcatatgattgattgagctcaagagtatttgccttatgcttcaatagattgccttcccactgttcttcctctcaattttatgattttcctttaaaaacttatctctgaataggaatgatatgaaattcttatcttgactgggccaaagtgaatacatttatgaggtgtgtgtttgttgtttgtatatttgcagtgttgtagataagctatactatgctcatttttgttcttgaatgtaatcgttatttaatattaactgttcaccaagaatatagtgaccagtaaactagaactagaacttaagagagacaccaaggaaaatagaagggctctacccttaagtggcctatggatattgccttccaattgaggcagaaactttgtcttgtttcccgctacatccctcctgctctcatttgtagaatagggcctgatgcataataagcattcagtaaatatctgttgaatgaatgagtgaatccacacatgaataaaatctttaaaaaatgactgcttaatagagtacacatgatgagaagctataaagaaaagcagcaatcaggatcagataagattattcaaggaagaactcttggagagtttagtgatttagtaaggagggataagaaatgatcagaccaatatgaagtttgagtatttgcatagtagacctggaagaattttaagacagttggagcctagattgataaggcatttttaagagccatatctaggctgaacaggggagaatgacagtagactggtgaacgtaaaagcatcaagtagtttgaggtatggatgaaagagagcagctctggtctaaagaagagaggaggtaggtttaaaagtgccttggatataataggtacctaataaacactaattgaatgggtgtgctagcagtagtttaagagtttgctttttctttctttctttctttctttctctctttctctctctctctttctttctatttcttttctttttttctcttcttcctcttctccttctccttcttcttcctctctctttcttgtctttctttcttatcttcctttctttttttgacagagtctctctctgtcgcccaggctggagtgcagtggcgcgatcgcggctcactttaacctccgcctcctgggttcaagtgattctcctgcctccgccacccaggtagctgggattataggcgtgcaccaccacacccagctaatttttgtatttttagtagagacggcgtttcaccatgttgggcaggctggtcccgaatgcctgacctcaagtaatccacccgcctcagcctcccaaagtgctgggattacaggtgtgagccactacatccagccagttgctttttttcttaaatgactatttcaggaagtctgttatagcagctgtctataggatggactcatgggtgggtgtgtgtgtgtctgtgtgtctgtgtgtgtatgtgcatgcatgtgtgtatagatcgggagagcaactgaaagtaagatctgttaggtgttattatagcttaaactgtgttggctatgaacatacaaagaaatgaaagaatatgagagatgttagaattaagacatagtagtagattggatatgatagacaaaggaaagagggaagaatgataattccaagattctgagactggaaaaattaggtaagtgatgatgatgatgactgaactatcaaaaggatgacattttgaggaaagatgaaagccatctggggcatgctaagtttcagagtgagaaatcttatagtcacctagaggtctgtgactgaggataacatgataacattaaaatattagtgtggcacaaaggagatctccagtagtgctgcaatgttgagcaaagtttctgaacctcagcgttcctgacatttggagctggataactctttagtggcggtggtaggatgctgtcctgtgtattgtgggctatttagcagcacccctggcttttagtcaccaaatgccagtagcaccccacctccagttgtgacaaccaaagatgtctccacacattgctaaaatgtcccctggatagttgggcatggtagggggtggggggattgcccccagttgagaaccattgatataaaggcaaaaaaggaaactaccatagattggaccttggagtactgtaggaggcgggagtcagggtagggttagggagaaagtggatctaaagatcaagccagggagtaaaagcagtttagggatctacattaagaaaacacagaattggagaaagcaaggaaaggatttgacaacttcttgaaagttggcatttggtaagaaaactttaatagatgaaggatttactccattcactgaatgttcaagagggatttggcttaaatgatagatttacttggaatcttgagggctcatgggtactggtctctagattagaaactagagtgactaatctgtggtcctcacaactcattttatgcacaaacactcgaaccactatcttggctttggaaattctttaagtgaaccttcagttctttgaacactgaaaacagaaaaataaatcatctagggtcttatgacaagaacacacattatatagtatgtctcttgcatgtacatacacacaaactaaagcaaaacttttgtttttacgcctaagaatgtgacagtacagaatcttaggaccccgtttggctgagccctcttggatattggtcagtgttgaaggtgaaaaggggattctgattcacaaccaatttgggagttaaagactcttagagatcttctgagatcatgtatctagccctgttttttttttttttaaacttctgaaatcctggtggggcagggcattcctaagagagagaagatcatgtgcaaaggcagtgaggggtgaaatattatgggctattcaggaaccttaagctatgtaaccatactgaagcatcaagtatgaaaagatgatggaacaaaataaggtgggaggcccattctctagggaagacaggtaacagacaacaaaaatgaacatgaatacaacacacacaaagctctggcaattgttttttcaggtgaaattttaaatagaaccctaatacgtaaaacacataaaagaggagccatctgatacaacccacccaccatagtggcccctcaagcacctccaccaaacactgggactctgcatcaccatttgaagacctctccaggggtttgccaacttttctctaaaggaccatattgtaaatattttggagtttgtgggccatgcagtttcagttgcaacttcagctgttcgactctgccattgtagctgtaaggcagctatagacaaaatcaatggacatggctggatttgggctgctgctgaccattttggtttgctgactcctgaaacccccctcatttttttaaacaaatgaggtctctgtagctgagaatagagaagcaagttgctattaatagcagagctaggactagaacccaagtctcctaattgtcaccttgttcctttacctttcattgtgctgtcagatagaaatttctgatatgtatatctgtgtgtatgtgacatacacatacacacacacacacacacacacacacagagagagagacagagaaagagggaagagagagagaatgaaagagagagaaagagaatttgttttgcctaggggtctttagttaaatagtactttttatattaggtaaaatatttctttctcctaaagcagaggtaccttgcaaatcatgtcatttggaaagaaatgcagtatccttgcagctactcagtggttgcttctaactgtatttccaatgaacaacttgctatccaaagatatctacagcataaagtgtttgaggcctaatgttatatgtcctcctgtgggaaaatggctatatttgcattgtctaattagacaatgatgtgatcattagagttactgagagaatgatagccatgtcaaggatatctggagtgagtgttcaaagttgagaggactggaatgtgtatggcttggtattaatttttctctaaaaaagaacaaaccacctggagtactttctgtactatacactctactaagcacttaatgcatcatctcatttgatccatataaagatacatcatgatttgtcatgactaaggtaaaagtgaagcacataatgttcaagatagtagtggagttaataaagcgtataggtctttgttcctttttacacgtagataagatctagaaaatgtagagagtgtaacttagaagatggttggctttgttgattgcatctctaggatcttggactggtcacatgcaagagttgtctttttctaccctatctagagagtaggcatttactaggtgattatgatgtttatgggtgagttgcactttttctccttttaaatgaggtgggaaaactatgccagccacagtggtcttgctaccttgtggaaaatcatcccagtggcaaatcaaaatgagatattttttggcttgctttgtggaatttatctgacctgcatgcctatctttagccaactcggagaactccccaggcctttattgcatttcccttccagagagttggctcagtgacttctattgcgggatgcttttgctaggatatttaggtttcctttctgaagaaatccacgtggccctggattgcttatttttcagttttgtgagcttgcattgcagtagtttaccaccaaggcaagaactgcatgctatctaagtttaattgcctttaagtataactgctgcaagccttagtaattatagttcacattctctgcgttaacattgccttgctcccttaggactttcagagcgattcacaaataaatgcattcagctttaaattgctcataaggattataagacccaaaaggtgaaggatagaggttgtttccttctctccaattattcaaagcttagcaaataggaaggcagaggcaaaagttttggttgccctagtcagtgttgttataaacagccacaaatcccggggaagaaaggtttaaacttactgaggtaaagagtttgatggtgttttgtttgttttatttcctaggaaaagttctaatggataaaaacatataggcttcgaactcacctcaactggttttcaaggctagattgaactagacttggaatgaaaggaaatgtcaaagaagtacaacaaaagtcgaaaaaggttttgtttgccagttacctaggcaaggcatactacaggtctggtaggaaaatacaagatagggttccttcgacttagagaaagttcagcaattctaatttgaggagggggccattataagacaaagagggtttttctatcactacatgctagtgctgtctgactggaaattctaccaagtagtgatttggactcattaccatgaaggtttctgcaatgagggagtcaggttggttctgccagctgggccccagctaagtggctgttaggcaatgctggtagggtgggtaacttcttatgttgcagttatctacctaggtaactcaagagcttgggaatttgttgaaaagtcagaatcggatgcctgaatttctttttgactagattatcaagaatattttcatattttaatctgaagagtgaaggtgtctctaacatcaagttgatgttgatccctaacatcaacttccatcagaagaataatgacagatgtgacccacttggaagaatttctgctttggaaacagctatgagttgatttattagcattgaggaggccccacaagtattacgagaagcataatctgcttatttattaacaagttgggaagcctgcagtttccccatatcttctttaaagaagaagatatatatcttctttaaagaagaagatatatatcttctttaaagagctctgagatctttctcattattttatctgcatagtcaagcttttgcttataagctacaaggttgcaaagaactcacactcttattccctacttgcttctacatttgcttttggatatggcttataggcttgcaaagaggaataataatgtttgactcatttagtttcacttttgagtcattaatttgaggctttcgggatcttttatggttccagaataaaagttgagagactatagcccagggtctccaattcaggctcatgaagtagcaatcacaaataacctaaagaactagcaaggcagtgctaggcgatgtggagactaaaggcttttgacccatcacgtgacgcctttacttttgagaagcagaaactttccaggagagcagtgatggattatatggggtgattaccaggaccaaagacttcaaaaagacaattctgactttcttgtaccttcagcagttgatcaccctttttctcccacttggagaagagacagctacataaaaggggtgggctttctttccataccaaagcaaacctttcttcctggagatccacccttttaaagcatttgcctaatgcaataaccaaaataagatatgccttcccaagaataatccatatgagaatgaaaaaggccagagataaggatgtgcataattgggaatctgaaaaacttggccatctaacatagatggtactgataagagtagactttgggaaggtatagagatagggaagaaggaagaggtttaaaaggtattctcgattccttcacattctctttatgagcaatacaaggcagcctgctactcattgtgaaggaccttctcgccatccattcctttttgcagctggactctaaaacaagaagagatctaaacacaaggctggatttaggggatacataattgaccctgttgcttgctgtttttcctttcaccttgcaaattacccaacatggatttccagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcaggtatggagaacttaaaggaagaaagggaaaaaaaagtaagaaaatgacattattcctggttgcttatttttcagttagcatttgacatgaacactgaaagcacacacttgctcatttttacatttttctcccacctaatcttactccagagtgcctcccaattgtgaatacaaagtctgtttccttagcttcctatcccagaaatatcctttaagccttttatcttgcaccttttattttcacatgaactccaggaacagtagacgctgtaagaattagcgctgctacacaaatacacatcttgatattgtagaactagaaatggtcttcagaaatcatctggctgtaccacttttcagttttagatgaatgaaaatcaagactaggaaaagttggcatgagtcactaatgataactacaacaagttatgggcaagataggatctaaatcctagattttttttttcttgagactgagtgcagtggcgtgatccaagctcactgcaacctccaccttccatgttcaagcaattctcctgcgtcagcctcccgagtagttgggattacaggtgtgcaccaccacgcccagctaattttttttttttttgtatttttagtagagatggggattcaccatgttgactaggctggtgttgaactcctgacctcaggtgatccacctgcctcagactcccaaagtgctgggattacaggtgtgagccaccatgcccggccagatttttaaattcccatttctgttgtgtgttatgctggcaggcagggatggcaatttttaggccattaattcactttctgagtagcatgacagtttgatatgacaggcccctttcctggccaagggaacctcacattcaagcccatgataggaagtcctgtggccctgggaggagatctgaattccccctgcttctttctgaatcagagtcgaaacagaagtaggctgggcagtaatcctctccaagaataggggctcagacaccatggttcttctctcactaacttgagggttctctgcatctgccccaacagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagaggtaagtaggtagctggtagggcatgagtgggaagaacagaaaggtcactgattcatagatttttccagtgttttattttctttaatattctgggtttcccccccaatttctgcctaagtgtgttttctttcatctgattatgcagggaatgaacggctgtagagacagagggtcagggatttgaacatcaaagttgttttataaacttcttagaatcatagttcagctttccccagaagccagaatgattgcagatgggatcagctgaaaatttgcacccctccttccccagagccacagattctttcagccacatatgcaggttgtttagccccaggaccggagtgaaagcccctccagagaaactaccactcagaaactaaatgtcactgaggagttgctgctgtcatttgatagctctggcttgtccaaggtatgtcaaaggctgtgctgaacttgaacccatccctgccctttgggaaggtcaatatttgaaggccacattctctatgtgcataacctcatcgtgcgtgagcggtcacatttcatctggtaagggagagaaagtggctggaggatttttactttttgctccttatttgttccccttttcaaattataaaagtcaattattggcctttggaggaaatagttgctcttacctcatgtgtcttaccttgctgctgctcaaaatcatcagttggggtaaaaagaaaggaagaaagagaaagagaaaaagaaacaacaacaaaaactgaattaaagtcaggtgatgacttgggttgtggcgataacagagccttggtctggaattgggtatgaaaggcaggctacagtatattgcacccagataggtctctacccagaaagttattaaaaaccacagtgttgtttttaacattctcctaaacgtggtaagccagcagagtctggaagtgcttgccagactttgggttgggatatgtatgtggagtgggcagtggatacatttatttttgagtccttccatgccaaatcagaggtggggaggttcagtgctaagagctgaaccggtgctttataagcccacttcggttctttaggaagacatgtctctctaatgtcatctgcttgtcttcattagatatcatctatgcctcaaatggatggaagctgcctgtggcttgattttgagcttaagctcatggacttaagcttcctggccttgtttcctaagcaaggcatactcaatacatgccagtgtggcaatagagtgcacagaagccccagctctgccagaagatggtctcgaaggttgtaggcaggttagaagcagaattaaatgtaattttacctgctagctcccaaggaaacacctgtgtccagcacttgttcagaggttatataagaaaccctgatgctgaaaaaacattgttattattgacaggtggaaagatacagggtaattttgtcacgtttaggcagaagcttagaaacatacaggtcacgagagtgtgcagtgtgagaaaatactagaaagctacggttcatggtgcctacttcagaatagactccaggtcaaaatgcaggagagcttcaggggttgtcacttgggggccttgtataaagaaactaccctccttccttcgtcctttgaaagctttgtgtattcggggaaacccctttcagatggattttcagaatctgttggctcccacaaggtagatttaatttaaattgaattcattttaatcatcacgtagaaacttttcatctaatcactgtttttggcaaaatgtgcatgcctatcatttaacaggctaaaacacagcctggttcccacctagaaagaacactttccaatagttccacaggtgaacattccagatcacgactgtgtgtctttctggcatgctactaatccaatccacaggagatgctgacagagagattgtattgaaatttctgtaaaatatgggaattggactaggtgattccttcagaccttcctatttctaggattatattacttttccagtgatagtgcctcttacgttctaccatggaggttggttttcttttcctctttcctttcaaatgagattctatatttgagaggtaacatttagaaaactttattttaaaacctgtgggctcttctgcctttctttccaacatttctttttattccttttgtctacttgttttcctcttctttctctcaatcttaaatgtagctattgaccaaggttctgctctttgcccctttccatggtaaaagttttatattttcttttctttcaaaataatttttttttttttttgagaaggagtctcgctctgttgcccaggctggagtgcagtggtgctatctcggctcactgcagcctccgcctcccgggttcatgccattctcctacttcagcctcccaagcagctgggactataggcgtgtgccaccacgcctggctaattttttgtatttttagtagagacagggtttcattgtgttagccaggatggtcttgatctcctgaccttgtgatccacctgtctcggcctcccaaaatgctgggattacaggtgtgagccaccacgcccgccctcaaaataattttcaagtgtctaggatattggctacaattggaaagtgctcaagtgtatttgaggaaggaaggaaagtagaaaagaaagaagaaaaatggaaggaaggagaaaggaagatgtgaaagcaagaaggaaacaatttctaaatgtataaattatatccctaaatctggtgccacatttcaatgatctgcttggtttctgtgtattctaccaggatctcaaacttaatatattccaaacctaatagctcatttggtaaatgacagatttcacaattaggatatcttgcttggatggtatcaatggtagttgggtaagacaatttttttcaattatgatattggttacatattaaaaaatcacctgttgtaagcgtacggtttgatgaatgttggtaattgtatacaatagtgtaaccaccaccacaattaacacagaggacctgttctaaagtgttcttgtgcccttgaatttgatcgcttcctcccatgcctgaccccaggcaatgactaatctgttattttgtcataaaattataattttcttttccagaatgtcatataaaaggaatcatattgcatttactcttcttgtttgacatattgcactcaacacaatgattttgaaacccattcaagttgatgctgagtagtgttccatggtgtggatgtatcacagtttatgtatgcatatttggatatatgcatattggggtcgtttccagtttttggccattgtgaataataaaatatagattataatataagaacaggcaagtgtcttttctcaggtgataagtcgtattaggtggtctatttataccccttccaacactttgatattatgatacacctcttgtcaaagggaaagctgttgatgttaacgatttcagacaagatcagagcgtgaaaacctaggtttttagccttaaagagtccaggaggaggcattttgatgcatatggaaagtgctggcattgccctttatcctgagatgcatcttaaacatcagatacagcaactctgtgagattggtcagctgtatgtttaggtgaattttccttgatgaaaggttaagagggccaagagataaagagaaagagagagaaaattgaagatattttggcatatctaaaatgagtatttgatacttaaaatatttgttttgttcaaagtgataacaggaaatttatttctttcattttatttagataatttgcccaagatcacacacagctactaaatggcagaagaactaggatttaaatctgtatttttgtctccttagctgctataattctgctgcttcttagaaatggtgtagctcaaagatggtaaaataggaattattagctgttcagtaagatactaattgaggctaattatttagttacctggaaatattataaataatcacaataatatggcctgaattaaggctccatattattttgtccctagggagtcctctctagatgcttaatatagatgaggggaaattactactgagtaggattccttgttcattcgcagaagaaccaatttggcaatgcagatttttagtttcagctcataaacaatgaatttatttctgaagagcagcaaaaggatgacaagataacccacccagtcaactatgtaatttttatcagcttgcatttactgaattaggttgctacctttctcagaatgtgtaatgtttcatgtttattttgagcaaaagtaaattctggaaaggaggaagtaaagaaaagggaagcagaaggtagaagctgttcacacacataatgcatgtctacctattccctctttgtaggcatttctcaatttccttcctctgctttcttctcatcctaccttctgtcttagttatattgttctctgctctagcttctcagtaataatagcaatgataataaccgtaatagtaactctgatatctctaaaattaaagttagaactttgaacaacttgttagatactggcatatggcaattcttaagtcactttcactccagtgtacctaaaatcaaaacccattgcagtgctttccaaaagagcctttcctcagtttccttttacagcaaacagtatttcatctttcctaggcatttgagttcgaaagaacaaagttgttattcattcttccatctccctaactcccacattgatattgtctccaaattctatcagttctacttcctatagcctatttccatttccgttgccacttcgctggtgcatagtttcatgatctgttgctgggattattacaatcaccttgctgactggtctgcctgattccagtgtttcacttctcttatctttctgtcacatttctacgagagataaggccgtcttcctaaggcatggcttagatcattttattcccttggaaagctctaataattttcagcgcctattggaataaagtccaaactcactgctgtactagttaattattgacttttttctcttcccttgtaagtttcctacagttaaggactagtcttatccatgcctttcccctctccagcctcccaggaacttcaaacacagtgctccacttacgtagagttcacatattaaataaacaaaacgatgatgctgataggaaaagataggcttgaagtttgaaaggccactaggtgttttaggagtttattggtgacatgctagaaagcagtttgagcaatgtgatgggataacttcgtcaaaaaaaagaaggagaaagaagatgacaaactgtttacttaagaatttgagatggaggttgtcaacatcaggaatatgcagtttggggtttgcaggttttattttcagatcgtagcccagcatctctctctcctgatgttcttaaagaacgtcttggagtattggaaggtagcaggtcaagttgctcgttcaaatactgtgcttgcttgcttttgcctaagccattggcctggtagccctagtcttctagaaggaagattgatgctgagggctgccctggcagccctgtcggaattcactaagtgccccacattttcaggctccattcctgaggagttaacagtgtccatatcaattagctggcagggctctgagtccccaaaatggtcttttatgcaatgaaagtggcagcaggccagcactagttcccccagtgacaaaccgtatgctcagttccccagtgtccgtagacaccatgcacttttcaacagtcctggctctaaggccccaaccttcacattggaattctgcagtacaggaattgcttccaggattttaccaagagctggaattctttcaagtcagaatctcttgtaatctctgtatgttagtctccttccatctttccacctatgtgattcattctctctcgctctcgctctcctccacctctctctttccctccttctctttttctttgagagacaggggtcttgctgtgtcacccaagatggaatgcagtgacacagtcgtaactgactgcagccttgaactcttggccttaagcaatccctttgcctcagcctcctgagttatgtggttctctcttaataatagctttgttgagtgttttgaccatgcctgacactgtttttacatgcataattttatcctctatgagatgaagttacaaatattgttcccacttggcatatgaagcggcatgcttagagcaggtaatttgactttcagaggtcataaagcttgttaggggcagagtgtacttggagaagctgggacctgctgagttgtctgtattcagagcctgtgctctcaagcactatgcaaatgctgcttcttcttgggtacccagtaggactacaagccagtgaattgcactagagaaagtatagaatgctgagatggtaaaatattttgagtttggcaaatgatgaaagccattgtattctttccccttcttgttctccaattatttcatcattccataaatggtttcaaccttgcatataaggtacacgtatattttggggaacagtaattttatagaggctcaccaaaatccccaatcttaatagcaactttctgcctctttttcttgccgcttcatccccatctgcactagacataatcttgaagctaagagaacatagttagctcccaacagaaaacatgcctggagttctcttgcagatccccattctcttaggaagtataatgaagcagtgccagttcattgttttctcggtctattgtctgatttccttgaagaccaatataattgcatcagtattctccctaatcctaataacctccctcacccgcccaccacacacacacacacacacacacacacacatgtttttccttattaattggtctttgagttaatggcctgagacactttcaaatggaacatgatggtcctttatgcagttagaactctggcaagagaacagtcactttgttggggtagacccattgatttggtgctagaatgtttcagatgtagattagataggaatcgagtgggactgactcaaaggcactatttattagctcacatgccctacctaatcttagctgatgtgtctgttgtttgcttctagtactcaggtgtatttaccaatgttcatctgtagccataagttacttagtataccctctgactttcttgaaagtctgacctttccccctctatgacttctaggagaataaaatggaaatatatacatattccttttttttttttttttgagacagagtctccctctgttgcctaggctggagtgtagtggctcgatctcacctcacaacaaccttcacctcccgggttcaagtgattctcctgcctcaacctcccagatagcggggattacaggcgtgcaccaccatgcctggctaatttttgtatttttagtagagacagggtttctccatgttggccaggctggtctcaaactcctgacctcagatgatccacctgcctcagccttccaaagcgttaggattacaggcatgagccaccatgcctggcccaatatatacatattcctgttgcttggccatgatctaaaaacttgaaggggctatctgccagaaggttttgggatgatatctgttcagttctgaaggcaagtctgtgcatatctcatccctcactgacttttgcagccacttctatactaataacgttgccttctaccctgaacgctgaactgtcctattttggaggctcttacgggttagttccccagaaaccatctgttccaaatgtgcttgatttcagcttaggactttccagaaaagccttccttgacttagaagaaagataacattcattgatcttgctatgctcccatctcatcacttccattttcctccccagggacacaacagtcatcagtcactctcctaacaccagctatgacacagctctagaagctcgcatccagaaagaggaggaagaaatcttgatggccaataagcgttgccttgacatggagggcaggtaaaatgttgttctggaccctgaggaatctgagacattgatatagagaccacataggatctttattcacagctaggaaatctgatcatgcagcctccccgctccaccatcacccctgccagcctgtcacttaaaggtgtgagatgcaatgacctttaccttgataatctccactaaacatggaattccaggtagggtttctgtccctttggccttcctaattgcttttcctcttccctctgcctgagctgaattgttggcatttgcactctggagtattctttctagcactgcaccacaaccctgtgatacagcagattgcttaataaaagagtaaaagaacatctgctcggccgggcacaatggctcacacctgtaatcccagcactttggaaggccaaggcgggcggatcacctgaggtcaggagttcaagaccagcctggccaatatggtgaaaccctgtctctactaaaaatacaaaaattagccaggtgtggtggcgggcacctgtagtcccagctactcaggaggccgaggcaggagaattgcttgagcttgggaggcagaggttgcaatgagtcaagatcatgccattgcactccagcctgagcgacagagctagagtccgtctcaacaacaacaacaaaaagaacatctactcaaagtggaggtaggatacctgattccttttataaacacatgatcatttacttactacctgcaggttgtcgctcattcatagatctcatcttctcactgagtaaattgtttccattgactgagattcttcactacagcacctagtacatcagttcattctctcatattcagccttttttttcactggtactttattgtgacttactaagatttaagcaacagctcctggatgctctgctgtatccatttgggtgtgcagaaaaaagaaaaaacatgttttaaaaactgtagcacaccatcccttgttttccaactcagaactaactagatcagcctttagtcgaaaagataatgggagctccacgtagtcatgtagtcaattagaccaaaatgtggaggtagcaagaaggtttttttttttttttttttttttttgagatggagtcagtcttgctctgtcacccaggctggagtgcagtggcactatcttggctcactgcaacctccgcctcccaagttaaagtgattctcctgcctcggcctcccgagtagctgggactataggcgcctgccaccacacccagctaatttttgtgtttttagtagagacagggtttcaccatgttggccaggctggtctcgaactcctgactttgcaatccgcccacctcggcctcccaaaatgctgggattacaggcgtaagccaccgcgcccagcccacaacaaggtctttatatgttctttgcctttggctcctaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggtaatgacagtaaataaggaagattatagtcacgtgttcaaagagagccctgagataagcacccatgcttaaggaaaagggatgatggtccaggttctagagaggaaggtgtaccagggttttggagtttttttttcctcctgagaccctagttccacattctggagctcctccacactttgaagtctcccggtgagaataccgattgaggccaaggcttagaggacaagaatcttgagtttcatttgggtgtcaaggaagataactctaatttcctctaaactattctcagatttggcctttgccatgtggcacctttatctttctccaaagcccatgtggcctttgtgtcgttccaaatgtcaaaattccggcatttctgtgttccttcctcctctataataggagaacccagagttttagttacactaaatcgtttgggtagcaggttttgttcccacagtgttgtgagatgagaacagaatgtactttttcattccgttcctgtccattccctcccctctaatcaaaaccccagacatattgtggataccacgaggcacatttttagagcccgaggaaggaagcttatatatatttttattttaaccctttttgttgctgttaattcctttcttggtcctctgatacttgtaatatcttttggttagaataagcattttggggactatggtcatggtgagaacctcagatcacacaattattaccacactcaatctgtgtcaacagacttcttccccagatcctttcttgctccctggtaacgtgtggtaatggtttataagtggagccgagtaggagcattctgacaacttggtggaacccaatcaccattggaaaaataaatcaaaacagatacccaggtcacttacaggcttaatatgttgtgccaggtgatggatgaggaccagaagggatcctcgaagtctgtaggaaacttttagccatggttggaggagcctcacacactgatttctgggttccctggaggcaaaaataaataacttagactattctaaattatttaatatttaaaaataataatattttaaatatttaaataatatttacttatttaaaaataaataaatttcttctgaaatttgaatgggagaacaggtaattagatgtctggatttgaatcacctattgttttctaacatctgttcctctttcatttgtaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacaggtaattattccctttagcaggtaggttttggtttagttctgctctcaaatacagatttatttcttgttgtctgatgtctgggcagagttatcatttggactgagtttttcacgttctaaaggagagagaagagagtctgtaaatgacttctcatccaccaagatgggaacaggcatgagtagaggccattatcttagcagaagtaaatgagggaggtggcaggcaagtctcactttgccattggcttcatgagggctctgatggtgtctggttctagaaatatgggttttttcttcatccctaagtgttttctaacccttatttccatttagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgc

SEQ ID NO: 1198 - DNA, 107396 bp, mus musculus
cctcgccccccaccccccgcccccagtctgcgcatgcgtcctaagaaccccttacactcgcggcacaggctgacagtattgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaaggatccttctacctgcaggacaaagtttaagcatcctagcttggcattcaggactttcattgttgggctccactttattgttgcaaccttattccccaaaatgctcccacatagaatcctctcttccaactaggtcaactctctgtctctcaaatacattttgtgcatttctgcctcatctttgtacaagatcatctgtatgcttgggatttccctcttttctccgtctatttaattttattgaagccccagctcttccaagaaattgtctccaactcccttagtccacaagaatctcctgtttctttgaattcccatggtacttattgtctttaccacttacttggcagtgctggttttattttctttttatgtttctgtcttgctatccctgagaagaaatagagccccttaaaaggcagggtgtaagccatatacttgttcagtcttcttattatatatcccctttattgtatttgataatatttctcataaatatgaatatcatctgatgcagttacagcctttggcttttaagccttcagttggttttctgaggcaagcttcaacacaaagcagaaccatatctgttcatggtaaacattcattcatcataagtttcattttactttttctcttcagttgaatgagcatttcttgtgggaacatttcaaaaatcagagtaaacaagatcttgtgctgctcttttttttcatttaaattagatatctttgggtgactcatttgccatttgtttttgataaaatttagccacgaaatttttaggggcagtattttttaatgtagagagaccactattcattatgtgtaaatgacggcaggtacattggaactgaagaaaaatagagtgtgtttgagattatacatacatatgtacatacatacacacacatacatacaggaacacacatacagtatattctctatttgatgaaaatgatctgtttggtgatcttgttatacttaaaatgactcagtggaatactgtttcagaaccaaaccgattagttagacaagcattccttattgcattaggaagagacaagaggaagggaaaatagctaagaagcggttaatgttaatctaggtgagaggtggtgagaatctgggtgaaacaatattgaataaggagaaattaatacatttcaaaataaatgggggaaggtttttttacattaagatgaaatagacccctggttctccaccctggctgcacattacaattgcaagggagattttttgtttgttttttcaaccctgcctggatcccaccctagaccaattaaatcagaatctcaggggccaaggaacttaaggaaaaaaaatcttcccaggtaattctaatatgcactcagggctgagaaaccctaaaattgtttattttttaagcactcaagaaatatttgttctttgagtgaataagaacattgataaaagtttagttattaaccttaaagccacttgtcaagaaagtcaaaaccaaaactaggaactaaatactcaaaaattgtttcaaattgtttgataaatttacgtgaagaaaatgatgccccctaaacatgtagcagcaaaatcttttctctgctaacaggcttcctatgagggaaaatgtattttaggcagctgtttgcagagtttatctttggtgtctttttacctctctctgcatttctagtgtctgttcttcacttgcctcctccctttgtccccatcacacttttctcctttctctttctctcttcaacctcactcctcttactttattgggatagagctcaggtaaatgattatggcagcctctctaggagattaacatttaaaagggggagtttgctaatttacttgaatctccaattggtgattggagattcatgacctttttgagtagatctcccttccagatactccttgattaaaattttcacccacataaggacataaaacagtgatcagaaagttggtaacccatttcagtaaagtagctgactcttgctgtaatgtcttctccgagatggtctgtagatagatttgacaagatgaagggaaattgcatagaactttttggtccatctggatactatgataatttgttgacttgaaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactcctactttggaaacatgattatggctaataaaaagagacatggtttttgtacttaaaggatttatacaatagtcaaatgtatacagtaatataacgattagaaaagaatttcactataatatataatagtattcaaaataatatattttaatatactgtacacataagagatctggaactgtggcataaggcttaattttagaggggattaatttagtttgagaaagcttcctgaaaagttaggttaggtatttgttgcatgacaggtataagaacagaagtggttgattgggatgttttaaaattggggttagtggaatacttttgcttaaggtttaaatttaatatttcaatttagattatttgtgatataaattctgaagcatttatttggcatgaaggtagacaagatccagaacctcactgagaacataagaagtaatgctagggacacttactacaaataaagataattgaagacttacaaaattgatttgctgggaggtgccatttgtttaagttcctaggcacacagtgaaactttgcaaaagaggcatcttgttctcccagcccagcctagcagcccactctgtgagatgccttaactgcatgatacacacctccccattctgcagaggctagtgatcatcatgacctagaaagggaaatattttagttttctttttttctctacactttgagtgtatttgggtgcttcttaaaacattgtaatactcttataatcagttatctggaaagtttcagaaagggttgtctgcttctcatttacagaaaaaaaaataccttacacgccagggaaccatttaatgtaattaaagaaaactgtataagccaatttaataacaatgtaagtttatgtttactctcactttcagctagtgcactcaatctgctaaaggtcaaactgtaatgtttaatctttacatttctcttgtttcatgtaaatagatagcattccattaacagaatacctgtcaatggactgtaatggataattcaacagtagatattttctaatgtattttttatatcaaattctttgaggaaaagttttttccaaataggaaagtaagttctttccttttcaggaacacttgattctgtgtagtcttttctaatttgtgacagagaatgttgtcactttatttttagattaattacttgtctcagtagaatattagagattcaaggtgacaagagacaggtataagataactgtgacataaacttttctttgaaccatatggagatgaactgattctagaacatttgtgaatttggatttcactcagaaatggctttttgttaatgattatgttcctaagagaatctagtatgtatagtctagagtttttcacttcttaaaaaaataattgcaatacgtaaatccttagtattttgagctacttggttggggatgtctatgtcaatgggaaataattacatttaaaggtttttgtgaattagaaatagtaaattaaacatagatgactgtgtccttaaactaccttaatgagtatgtaagaatggatttgtcatatagatattttgtaaaggttgtaaagttgctgctttcagtgagttaatgatttcataatggtttaaaataagaactcatatacctattatatcctagatcagtagttctcattgtggggaagggtagggttggagaggttgcctccagaggatatttgacagtatctggagacttttttttttttttttaagagacaaggccttgctatgttgccctggctatgttgcctgggctggaatatagtggctgttcacaggctctaactcgggggctcaagtgatcctcctgtctcagcctgctgagtagcttggactatagtcctgcagcaccacacctggctgaagacatttttgattatcacaatttgggggttgctactgacatctagtgggtagaggcaagggatgctgccaagcatcctacattgaaaaggacagccccatacaacaaagacttaacttgtctaaaatgtccatggtgccaaggttgagaaaccctgggttagagtaagataaatggaaagtgcagcataggttcaaagagggagggataacatttgatttggtcgtttgaacagcagaggggggctttataaagaagttggaggattggcctttagagaggaggcatcagattttatagttattcttagatggaggaaactacatgaatgctgatatctcagagtctcctcaaactcaatatgtcaaataatgaactctcgttattcaccctaggcccccttgtcacccagatctaaaacttgggagttattctccactcttccctttccctcagcctctatatctagtgagggactaaggcctgttggtcataactctttgaatagctttcagatcagtttcattcctttctattctcaatgtcattgttcagattctcctctattccttacctttaactggacctgtcagtagttttctaaatgatctctctgtctcaagttttcttcaacttaaattagttagtcctccacactgtagctaaaccattctttctaatatgcaaatctgattgtcatgtgttactaaaacaatgttactaaaacaccttcaagccagtagccagttttcaagccgtacgtttcaaaatcttatttccttattccttgttttgaacattaaaaaaagtaatacatacactatgttttatttaactgtggtaatttttatattttattagttaaaattaaattgctaagattcatccaaattgttatgtaaaactgtggttcattcttttggatggctgtgttatcttgcatcatgtgaatataccatctttattcactttctcactgatagccattttcattcccccctcctcctttttctcttgggaatagcactactatcattattatacatgtctcttgtacttgtgcaaggatttctcttgtgtatatacttgaaaatggaattgctgggttgtatagtatgtcagtgttcaaaccgatttatcatttctgtttccattgacatgtataggagatcctatgaatctatgtgccctccaaaacagtactgtcaaatttaaaaattttgaccaagtgtgtttaaaaaggtatttcgatgaagtctttcttgatttacattcccctgatcacgaatgatgttaacctttcttcagatgtctgttggtcatatgtctttcctgtactgtgaaatagcttttcatttattttgcccattttctgttggttggttgtccttttttaaaaaatagaattctatgggtttaaaaaaatactccttatactaatcatttgttttgtatattttgaatatcttgtttataacttgcctttttgctctttgaggggtgttttgatggacaaatttgtaaattttaatacagccaaatgtatcaatcttgaattttgtagtcaatgatttctgtgtcctgtttaagaatatgtaaaatatattcatctacattttttactaagagttttagttttgtttttggtattaaagttcttaattcatatggaatcgatttttatgtatagcacgaggtggagttccatgttcctgtttttacatatggattatcttttttcagatccatccttacctatgttggggctcagaaaacaatacccccaaatgaaggcctcagcagcagcctcagaagcagaagttttgcactgactttgtcctgccctcctgtctctctgtcccattctcctccaaggctagccgtagaaactagaatccctcttccccaaggaggatcacagaagccagaaccccttttcctgaaagccagccataagacctaaaaatattactctaatttcccctctgcctttctgtgtaaaaactggacacaaagaaatgatctaacctaccttgtttgactgtaggtcttaagacccccattccagagagggccctgccccacagtcagaaggaaggaatacaggctcagagaggcctagaagaatctatttaataggcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacctccgcctcctgggctcaagcgattctcctgcctcagcctcctgagtagctatgattacaggcgtgtgccaccatgcctggctaatttttgtatttttttttttttccagtagagacggggtttcaccatgttggccaggctggtcttgaactcctgatctcaggtgatccacctgcctcagcttcccagagtgttgggattacaagcgtgagccaccgtgcccagcgtgagtcaggatttcattgtggatttgatttgacttttcctcatgactaatgatgttgaacatcttttcatgtgcttattgactatttgtatattttcataagcaaaatgtctattaggaccctttgtccatttactaattggggtgtcttttcattactgagttgtaagaggtttttttaaaaaaaaaattctatattcaagttttttatcagatatatcacttgcaaatatttctttcctattctgttggttcatctactctgaaacacaaaattaaaacatactgatatcacctattttatctattttcttatgttgcttgtgctttttgtgtcatgtctaaggaagcattgcctaacccagggtcagaacgatttatccttatgtattctgagtttatagttttagctctttcatttttttacatttagctttactgcttatttaagttgatttttgtgtgtcatgtaagatcagggtccaacttcattcttttacatgtgggtatctagttgtcctagcaccattttttgaaaaggtcatttttttcttcatctgattgtcttgtgacccttgtttaaaatcagttgaccataaatgtcaagatttatttctgaactctcaattgtatttcattgatctatatttctgttcttaacccaataccacactgtattgattattgtagctgtgcagtaagtttggtaattgggaagtgtgaattttccgacatttttttcaagatttttggggctattctgggacccttgcatgaatttcaggataagctacacaatttctttggaaaatgcagaatgcaagttgggattttgaaaaggagtgtgttgaatcatcaatttgggggaattttgccatcttatcaatattaagttgtccaatccatgaataggggatgtcttttcatttatttatatctttaatgtcttttaacaattattttgtagtttcctatttttagtttttgatgttgttgtaattggaattttaaaaatttagtttttggattgttcattgctagtgtgtagaaatacaattgatttttataagtgatcatttatccttcaaccttgctgaacttgtttcttctagtagtcttttaaatggattcattagggtgttctatgtcatgtcatctgcaaatagagatagttttacttcttttcaaatctggagccttttatttctgtttcttgcctaattgtccccgttagaacttctagtttcaataatgttaagcagatgctgtgaaagtggacattcttgttttgttcttgaatttagggggaatatattcagtctttaaccattaaatataatgttagctctgtttttttcggtaaatggtctttatcaggtggaagaaattcccttctatacctggcttttcaaatgtttttatcatgaaagggtgttgaattttgtcaaaggctttttctgttctatcgagttaatcatatggtttttgtcctttgttgtattaacatggtatataatattgtttggtttttgaatataagatgaccccactttgcattcctgacctacctgcacttcagtttagtctcatactgcctcggacctctacattccagcctatcaaactataatatgtgctgctcgttgaaagtatcatgctgttcgatgcctcagggtttttctttttttttttttttcctgttaatatccttctttggctttccaccttgtgaactcctattgattctttgtatcccagatcaggcctttatcttttccctttcccctcatcttctacataacagtgattactctatacctctattatagccgctgtgattttgtattgcagtgaatatatttccttcaccctagtatgcaccatcaatttaataacttttctgacaaataaacaccacttcagtaaatgcatacatagatttcaaaaatgttagcattagaagaaaatatgcattgttgaattaaagaaatatgggttatttgtttgcatttccctttttattggttttagagttatttgagtatagtgactttgttgccactccagtagctagtagtacagtgtgtggtacatagtagttgtttagcatattttgttcaattaagcctgcttcttcccatgggtgcctttttgagtccctgcacaatttgtccctttggttttcctctgtgttttccactacttcataaatatataccctgttcttcagggtgtatatctgaacccctcattgttttcctgatttttgtttttattgttttgttatttttaaaaatgaaaaaaattagaaaaaagacatatcttgttattgcttcataagcagatatatgagtattaaactttaacagtttggaaatttgctgtagtttatatatatatatatatatatatatatatatatattttttttttttttttttttttttttttttttgttaagatggagtcttgctctgttgcccagactggagtgcagtggcgtgatctcggcttactgcaagctctgcctcccaggttcacgccattctcctgcctcagcctcccgagtagctgggactacaggtgcccgccaccacgcccagctaattttttttgtatttttagtagagacagggtttcaccatggtctcgatctcctgacctcgtgatccacccgcctcggcctcccaaagtgctgggattacaggcgtgagccactgcgcctggccggtttttatatattcttatactatgccgctagatatgtttttattttagagtagctggccgtttaaaaatatttaggttagcgcttcattaaaattgatttgaaagtactgtttatgatgttaaataagattgacattgaaaatactacattacaaaatgttttgaggattaatatgttcttttaacaaattctattttgaaaatcacgtttgtagatgaagtccaggaaaaatttagagataaatggacatttcatgattaggtttaggagttttctcggtagtatagctctgaattgtttaaaattgtgttttagcatgtcttggtcttactttgtcctcttactgtctgctctcctccattagccatgtgcaaagttaagatcccaggatctgctacctttcagttacgaagtttatcatccttagtaggatcagagcttaaaggcactcacaacagctctctgtattcactgcttcttctcttgcaaaaagcctcatcacttaatgaatgactaaactttctcacatttatcaatataatattgttgccttaaacatctttccattgtagtctattgtatactcttcttctacattgttctttcagaaagttttccttatgccaccattccactgaagaaaaatgtatggatgcaccataacttatttaaccattcctctatcattagatgtttaagttactgtttaatattaataaacaaccaggtgtaattgtgctcctggctttacattgctttctccccagagaaatttaaacttctttaggacagataatgcattctctatataaattctcgacagtgtttggttcaatgctatgactctctgaaatagtttataatagatgcttctcaaatttttaaactttatgggaaagagtgtgacaattttatatactgacttcctatactatttgtgtgtaggacaatgcctctgccatggtgccttggtgatcttgcatgtacccacataggccacataggcaaggctcaaccacaatctgtctcaagtcttgggggaatactctgtgatcctccttgatacatggtaagatagacttgtgaggagctgtcacaaggccatttcctatccacctctgtatcttacaggaggcggcctcaaggcagcttattatctcctattttcattttggtaaggcatgggagtttccttcaggcacagttgtgactataaaatgacatagctgcagtctagaattgactcctcaacaacagagcaacccactgtgtgtgttgtctttcatttagtccctccagtttgggtttctcttgtaggactagggacatggggagctgataccatactgatcatgccttctctgcctgtgttagtaataaaccatctgaatccatttggtcttgtcttactggcagctgccgccgtgctgatgtgtaggggctgcttgaccacttaatgtaaacaaatgggattttttttttttccagtttgtggaatttgtcattactttttaattggtcaatttattgtaaattgcttttaatttcaggattcagtggttagtgctttgctatcaaatagctcaggtaaggatggtccttgctctgtaaatacagtattattttagggggtacagcatgcagctataaaattagtcttaatctgaataaatcaaagataaagcaattagttttgtttagtacagtggcctgcacttggttttcttttttcttcctctcttctcaaggactacttttgttttgcaatctgaagcctgcttaagttgtcctggagagtcagttggatgcagacctttctcgtattatattagactttcctttctcatgcagtagaaaggtactaaggtatcttaacatgcaaataaaatgtatattgtatacacagatctacctgattttcagtggctggttgaccttgacctaggcagaaagatcaaagtcaaactgttgccagtggagggtgtccaggttcttggtgttttgaacaaagaattggacaaaatgcacaaagcaaggaaagaatgaagcagcaaaagctgagatttatcgaaagggaaagtacactctacagggtggcagcaggccgagcagcctctcacagccccgatacagaatgttcttgggtccaaataccctgctagaggattcccattggccactttgtgtttacctcatataaatgaagtgatggcctgcaatcaatctgattggttgcagaaagcgatgaaacagagcctaaagtgaagttacaaagctgcactgctatgttaacgaagacttggcgtgcaatcagtctgattggttgcaaaaaacaaacaatcagaggctgaagttacaaagttatacgcctatgcaaaagtctgattggttacagaaagcaaccaatcagaggtactttctatttcccatctgccatgcagaaatagtgggggtttgccaaggggctagtctctggtccttttgttacttaggtgtggaaagttagggttttcctttcagtttagttctaggaagtcagcgtgaaacggccctgcctccagatcctatactcctgcctcaaaactaattgaacatcatcaattctgatgtactagacatggttaagatacatgttttgccattggttacttcattaatcagaataatcataacaattcagatattaggggttttttttggtttaaaaaatgttacatgaaagcatgattttgttgaattaattaattaattaacttttttattctttgagacgggggctccctctgttgcccaggctggagtgcagtggtccaatcttggctcactgcaaccccatcaaaaactgagcgaaggatatgaacagacacttctcaaaagaagacatttatgcagccaacaaacataagaaaaaaagttcatcatcacaggtcattagagaaatgcaaatcaaaaccacaatgagataccatttcatgccagttagaatggtgatcattaaaaagtcaggaaacagcagatgctggagaggatgtggagaaataggaacacttttacactgttggtgggagtgtaaattagttcaaccattgtggaagacagtgtggcaattcctcaaggatctagaaccagaaataccatttgacccagcaatcccattactgggtatataaccgaagcattataaatcattctactataaagagacatgcacacgtacgtttattgcagcactgttcacaatagcaaagacttggaaccaatccaaatgtccatcagtgatagattggataaagaaaatgtggcacatatataccatggaatactatatagccataaaaaaggatgagttcatgtcctttgcaggaacatggatgaagctggaaaccatcattctcagcaaagtaacacaggaacagaaaaccaaacactgcacgttcccactcataagtgggagttgaacaatgagaacacatggacacagggaggggaacatcacacactggggcctgttgtggggtgggaggccaggggagggatagcattaggagaaatacctaatgtagatgatgggttgatgggtgctgcaaaccaccatggcacttgtatacctatgtaacaaacctgcacgttctgcccatgtatcccagaacttaaagtataataaaaaaattgttatgagtttgggggtacaagtgtagttttgttacatggatatattacatagtgatgaagtctagactattagtgtaaccatcactcgaatagcgtacattatacccattaggtagtttctcacccctcaacccgctcctaccttcctacatttctgagtctcagggttctgcaggtacatagaagttgccaggttttcttgccatcctcgccattcgaaattcagttctgtacatctgcctatattcgttgtgatagtgcttcgctttttcatagataaccttcctccttgccttttgaagtatgttttgggcaaacttctttctcaggcacttgatcttcagttctgtaaaattcctttactttttcttaagggtttctggcacagcaggaaccttcttcatcttctcttctacaccctccatggttccagctggaaaaagaggatgatttcttttcttttgggtagatacctaatagtgggattgccagatggaatggtagttctatttttagttctttgacaaatcgtcatactgttttccccaggggttgtactaatttacattctcactaacaatatataagcgttctcctttctccatatcctcaccaactgttattttttgactttttagtaatagccattctgactggtgtagggtggtacattggctgtctcaaaattttgtctgttttaatttgcatttctctgatgcttagtgatgttgagtatttcttcatttcatatttttcattttttcatatgcttcttggccatttgtatgcatacaacaaaagcggtgcttgcttattgtagaacatttggaaaatagaagcatagggaaaaaaatacaaattgcttctcattccagcaaccttgaataaacattaatattttggtatatttcctttatattcccaacactcatcatcttgcacatacctgtaggtctttataaatttatgtatggtctttaaagaaaactattgctgcacttggtgtatatagttttacattttaaatactctagttattatactgtgagcatatttccatactaaggaatcgagtctataatatgatttttaaaggctacaggatattccatgttaaagatataaaaatttgtttagcctttatcttattgttggacatttaagttgtttctaatttttactattttaaataatcctgaaatatgcatattttttacatatctctattaggtttcaatcaaaaattgctattaattgaattattggatcaattattatgaacagttttaaggaccttgattcactttgccaaattgcacttcagagaagttacctcattttgtattcccaccaatgatgtatggaagtgcctaattcaaaatagccttgccaacaccaagtgatagttttaaaacctttaaatttgattaatgaattatgttttttttttttttttttttttgagatggagtcttgctctgtcacccatgtcacccaggctagagttttgtggtgcgatcttggctcactacaacctctgtctcctgggttcaagtgattctcctgccttagcctcctgggtagctgggactacaggcacacggcacctcacttggctaattttttatttttattttttgtatttttagtagagacggggtttcatcacgttggctagtgtggtcttgaactcctgacctcaagtgatcctccggcattgacctcccaaagtgctgagaatacagacgtgagccactgcacctggccaaattatgttatcataatttttacgtttattttgattacagtgaggttgaagatattttcatatgcgtcttggtcgttgatagttttcattttgaaactgtttatgtccttggcccaggttttatctatgagttgttggtatctttttgctttttgatagactgaagtttttccttctttttatgtaacttaacctagaaatctttcatgtgtgaattctttctttatattaacactttgaaactccttccccattctaatattaggtgactagtcactataatgtttttcttaaagcttcattttcatgtttatctttttcttccatctggattttattttagtaaaagttatgtgataaagcaatagtatttgtcttgaaaatatagttattcaatagccatttaataagtaatactacattgatttgaaatgacaaatttataatacattttataatggttgaagtatagtgccattcttaaatatctctttgatgtttgaatgctgttacagtgattcattagtcattatttcttggtgaaactgaaaaacttactagaatttcctacagataactgcatagagctgcccctccctcttcttttaaataaggtcttgtctttccatgtggcttaattgttgcgagactcacagtcctttccttactgagcatgcacgtatctgccctctggttagcagctgtggtttccccttgcaatatctgtttttgtttgcacctttgcttctcaaggttcctgtgctgaaaatgagcctttcattactggttgcttcaggtcggtgagatctccttgttattgtttatcataattgttaactttgaagcatttttttccttcattttttccaatgtctacaagttgtttttttctctctgctgcacttatggttaaaattttaattcatcatggagtagcttagaaattctgtaatccatacatcttacttgttcaacaaggtctcagtgttatagactgttcattattttgtcctgcacaacacccttctagggaatactgaatcaagaaatcacctgtctttgcagagggcatctgttgaggcagatgccagagccatggggttgtcatttcccatcaggctccatccagtatcagtctctaatacttcaaagacactttccatccttgcatccgacagacagctgtggtgccttctgttttcttgctgcttttgtttctagtcttaacagttcttttagatagaaaaatagatgaggaattgctaacatttgagaacatattaatcagattttacatactgtaattgtgctcaaatttgagtaataatagttaccaaagaacagagaacatttaattttttcattttcatgttaggaaataagtatctgagttggctgattttatgcactctcctgaagacatatttctgctatatattttttatgttacaagaaatgaatataatggtctaatttccatcattttattttctatctttatgaacattacctatcattatgtacaagttgacaattttcccttcatttctattgattatttcttctagggattttaggttgttgcagaatatttagtcattaccaatagctctgaaataggaattaagtgattttggcactatttaataggtagtagtagattcagaaatgcagttcagatcaagtctagtgttcatctcccctcttttttagtcagtaagacttctgtgaactttgagacataccccaaggatgatgctgtattggtctagccccaagagctttatattatagaaactacaattttagtagaactaaatggaggtgattctttttgcattctttcactgaagtgttactatctaagcaggtattatttggtgttggagtggaataagaattgatattacctagagttggtgtctggttgagcttttgatttaccctaacatctcatgcttagtttatagttaatgtttaatggaattttgtcaaatggatgataaaggctgtgagtcaagtcaggatgctacctggcaaatatggagaatgaggcttggaaggtgaggatcagaatttgcttgcctctatcacagactctggaaatgcaggacgacagataatttgatattaagatatttgaatattttaccttgtatgttttccgtggttaggctgcaacttctaagccctgctggaaaaggaatggtactgttcaaagacagttcaccatggcttcatgtttctgcgcatcttacaagtgagacactaactgccctgtgttctgaactttattttcaatgatgttggtacagtgaacagctttgcaagataaacctactgtttgccttcaaaacaaagtgcagactggacgcagtggctcacacctgtaatcccaacactctaggaggccaaggcaggaggattgcttgagcccaggagtttgagaccagcctgggcaacatagcaagaccctgtcctttttttttttatgagacaaggtcttgctctgtctcccaggctggagtgcagtggcacaatcggctcaccacagcctcaacctccccaggctcaggtgatcctcctgcctcagcctccgaagtagctgggactataggtccatgccactacactcggctatttttttgtattttttgtagaaatggggttttgccatgttgcccaggctggtctcaagctcctagactcaagcaatccaccctcctcggcctcccaaagtgttgggattgtagatatgagccactgcccccacccaagaccctgtctcttaaaaaaaatagccaagcttggtggtgcatgcttgtagtcccagctacttaggaggctgaggcaatagcactgctttagcctgggaggtcaaggctgccgtgagctgtgatcacaccactgcactccagcctgggcgacaaagcaagatactgtcttaaaaagcaaacaaagaaaacagaaacaaaccaaagcaaagggcagatttgcttgcatccttggacaaattagatagtatttctctccaaagcaaaagataatcatgcttaatgttgaataaaataaagataatgtctcccttagaataaaaggcaggcatgcttactatgataaaagatttgggttccctcagctcaggttcctttcctataatgtgataatactgcatgtgcatgcatccatctgggcccatcagtgttgcccccatgagattttggggagtacggggaactgacccaaatatactgttcatgccatttgctgtgctgtgagcaataaaggcctctgtctctcacacgggagtctcatgtcttctgctagcatctatacaacagtgttaggctaacatactggcttacaagtagggcaaaatccgacccttcagagttcttgacaggtactcagcacaatgcttttggctataagatgttatcctcctttagacaaaatttgtttgactaattttctttaatccttgtttattgaattggttaaaaatattgaaaagtaataagagcccatctctttaaggggccaagaaagctgtgtgtcatctcagatgaaacaattttgaattggtaaattgggaaaagctgagggctttataatggtgttcattattctctaaaacaaaaattgaacctagaagtaagatttacattctgcctcctattgcaagaagcaatcttgggggggtgtgtggatgttgttagatttagaattcttctgaccctggtgtgtggttgcagtgggacagaatatttgagatgtgggacagaaggccacagtagtgtgttaaaggagtggaaaatcacacatagaacataggctttgaagacacatgagtttggaaccccagtgctgtcagttattactagcttttcattttttttacctttgggaaggcatgtcattcagtctatctttgcttcatatgtgtattagtctgttttcacgctgctgataaagacatacccgagactgggcaatttacaaaagaaagaaatttgttggacttacagttccacgtggctggggaggcttcacaatcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcaccctctgaagccacggcccaagctgtaccttggccccttatagtcatgcctggagtggctgggacacagggcaacaagtccctagcctgcacaccacacaggggccctgggactggcccacgaaaccattttttcatcctaggccttcagtcctgtgatgggaggggctgctgtgaagacctctgacatgccctggagacattttccccattttcttggggattaacattcgggtcctggatacttatgcaaatttctgtagccagcttgtatttctcctcagaaaatgggattttcttttctatcacattgtcagggtgcaaattttccaaacttttatgctgtttcccttttaaaactgagtgcttttaacggcacctaagtcacctcttgaatgctttgctgcctagaaatttcttccaccagatactctaaatcatctctctcaagttcaaagttccacagatctctagggcaggggcaaaatgccaccagtctctttgctaaaacaaaacaagagtgtcacctttgctccagttcccaacaagttcctcatctccatctgagatcacctcagcctgggtttcattgtccatatcattattagcattttggtcaaaaccattcaacaggtttctagggagttccaaactttcccacattttcctgccttcttctgagccctctgaactgttccaacttctgcctattacccagttccaaagtcacttccacatttttgggtatcttttcagcagtgccccactctactggtaccaatttactgtattagttcattttcatgctacagataaagacatacccaagactgggcaatttacaaaagaaagaggtttattggacttacagttccatgtggctggggaaacctcacagtcatggtggaaggtaaaaggcacatctcacatagtggcagacaagagaatagagcttgtgcagggaacctcccctttttaaaaccatcagatcttgtgagacttattcactatcatgagaaaagcatgggaaagacttgcccctgtgattcaattaactcccaccaggtccctcccacaacacgtgggaattcaagatgagattttggtgaggacacagccagaccatatcagtatgttaaatgagaaacagtaactagcttacaaaattgttaaaaggattagaaataatctatgcaaagtgcacagtactgtgatctagcatatagggtgtatgtgtataatatttgcctcaattccacttaggttattcttgatgtgaatttagagttctgatttcaagttatttctccattaactcccatgttccttcaagcagacaattctatggtgattactctaatgatgaagatgtgttcaaacagcacacttcattattaggaattttatcagaggtaaaaatcacatggccctctccttaatgtgtctgtttaatttccctctgctttcctcttataaggatacacgtgatggcatttttagggccagagataaaagtgtgtcaggctttcaaatattacctaggatttttttaaaaggagagactatggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaacctttagcatataagataacactcacagattccagaattagggtctgatatctttgagggccaccattcagcctacaacaggaagataaatacacattttaatgtccttttttatgtggaaaaggtgaaccatttttataattgtcttttcccaagtgctgtttgttgcctaagaaggtaggctttgaaattgttgtgaagtgaatctcccacggaggaataagtgagcagttttccgatttttatttatttttattttttgaaaaagacagggtctcactgtcacccaggcatgagtgcagtggcatgatcatggctcactgcagcctcaacctcctgggctcaaaccatcctcccacctcttagcctcccgagtagctggaactacaggcatgcaccatgcccagctactttttgtatttttttgtagagatagggtttcgccatattgcccaggctggtctggaacacctgggctcaaatgatcctcccacctgggcctcccaaagtgttgggattacaggcatgagccaccgactgcacccagctgtttttttttcccccgatttttaggtggaatttttatttatttaattttttgctggaactcagttaaaataccagttttgcatgtatttctcaattatttgttcattattagtcatattttatttttctagttgccctagtatacatgttaattgatttttaatgtttaaaaagctcctttattgtatatcacaagataaacattttaaatcagtttaaattttattaattatagctatataaaagttaatcttcacttttttgatggaaaatatgagatgctgttagtgtgagatagttcaagaaattaagatacaaatagttttatgttatttcccatttttctttccaaggttgagtttttttttttttttggcactgttattgtatttacccaatgcttaggatgtttatactgattttaaatctgaaacacctaagaattagattttgctgagaccagctcagttgtggagaccctaacccagcggcgctagaggaattaaagacacacacacagaaatatagagtgtggagtgggaaatcaggggtctcacagccttcagagctgagagtcttgaacagagatttacctgcatatttactgacagcaagccagtgataagcattgtttctatagattatagattaactaaaagtattccttatgggaaacaaagggatgggctgaaataaaggggtgggtctggctagttacctgcgataggagcatctccttcaggcacagatcgctcatgctattgtttgtggttcaggaacacctttaagcggttgtctgccctgggtgggccaggtgttccttgccctcattccggtaaacccacaaccttccagtgtgggcgtcaatgccatcacaaacatgtcacagtgctgcagagattttgtttatggccagttttggggccagttcatggccagatttgggggcctgttcccagcaagatttattattctttatttaactccattaaattagaataataattataattttaagtggtgtttactaaataaatacatgaaatcatccagaaaatagtttatgaatgcacatttaattaaattccctgagggagcttctaatattactttgtaatttaactaaataatcttttatttggaggggaacgaacataaagaagcatgaaaaatgtgtagattagtaatgtcttgatattatttaaatcattaaattattcttgttattaatactgatgttttagtatatttttctgtccctttttggtagtttatttgcctttttatttcatttttttttgcatttttttttgtgagacagagttttgctctttttgcccaggctgaagtgcaatggcgtgatctcggctcactgcaacctccgcctcccaggttcaagtgattttcctgcctcagcctcccaagtagctgggattataggtgcttgccactatgcctggctaattttttgtatttttaatagagacagggtttcaccatgttggccaggatggtctcgatttcttgaccttgtgattcacctgcctcggcctcccaaagtgctgggattacaggcgtgagccaccatgcccagctgactttttatttcatatgttatttttcagaagttttaggtttacaaaaaaattgagcagatagtacaggtaccccatactccttttctccagctcatagttttcctatttttagcatcttacatttttgtaatgtattttttacaattaatgaaccaatatatggtacacttgatgatgatgaaaattgatgaagctatactttattattaaagtctgtacattaggattcagtctttgtgttgtatagttgtatgtgttttgacaaatgcatgtgtcatgtatgcatcatcacagtatcacatagaagagtgtaactgccctgaaaattctgtgatccatgtattaatcactctttgatatggtttagctctgggtccccacccaaatctcatattgaattgtaaccactatgtgtcaggggagggacctggtaggaggtgattggatcatgagggtggtttccccgatgttgttcccatgatagtgagttcttatgagatctgatggtttataagtgtgtagcattctcctcctgccctctgccttgtgaagaaggtgcttgcttcttcttcaccttccaccatgattggtttcctaaggcctccccagccatgtagaattgtgtgtcaattaaacctcttttctttataaattacccagtctcaggtggttttatatagcagtgtgagaatggactaatacagaaaattggtactaaagaagtggggcattgctataaggaaacttgaaaatatggaagcaactttggaactgggtaatgggcagaggttggaacggtttggagggctcagaagaagacaggaatatatgggaaagtttggaactctctagaaacttgttgaatagttatgaccaaaatgtgatagtgatatgaacaacgaaatccaggctgaggtggtctcagatggagatgaggaacttactgggaactgaagtaaaggtcactcttgctatgctttagcaaggagactgatggcattttgctcctgccctagagatctgtggaactttgaacttaagagacatgatttagggtatctggcagaagaaatttctaagtagcaaagcattcaagatgtgacctggctgtttctgaaagtgttcagtcatatgcattcacaaagagatggtctgacattggaacttatgtttaaaaaggaagaaaagcataaaagtttggaaaatctgcagcctatatggtggaaaagaaaaacccatttactgggaagtaattcaagcccgctgcagaaatttgcataagtaaaaaggagccaaatgttaattgccaaaagaatggggaaaatgtcttcagggcatttcagagatcttcatgacagcccttcccatcacaggcctggaggcctaggagggaaaaatggtttcatgggctgggcccagggccctactgctctgtgcagcctcatgacatggttccctgtgtcccagccactccagcttcagctgtggctaaaaggggccaaggcacagctcataatgttgcctcagagggtgcaagcctcaagctttggtggcctccacatggtgttgggcctgtgggtgcttagaagacaagagtggaggtttgggaacctctgcctggatttcagaagctgtatggtaatgcctgaacgtccaggcagaagtctgctgcagggccagagccctcatgggtaacctctactagggcagtgtagaggggaaatgtggggttggagactcacacagagtccccattggggcagtgcctagtgaagctgtgagaagatggccactatcctccatacctctagactgacagtttgtaccgagcacctggaaaagctgcaggctctcaatgccatcccctgaaaccagcgacgggggctataccctgaagagccacaagggtagagctacgcaaggccttgggaacccaccccttccatcagtgtgctctggatgtgaggcatggattgaaagaagattattttggaactttaagctttaatgacttccccattgtattttggacttgcatggggcctgaggccctttgattttggccaatttcccccatttggaacgtgtgtatttacacaatgcctgtacccccattgtatataggaagtaactaacttgattttacaggctcataggcaaaatgggacttgccttgtctcagatgagactttggagttggacttttgacttaatgctggaattagttaagacatttggggactgttgagatggaattttgcaaatgtgttgcagtgtgataaggaaatgagatttgggaagggctgtggcagaatgatatggtttagctctgtgtccccactcaagtctcatattgaattataattgccatgtgtcaggggagggacctggtgagaagtgattggatcatgagagtggtttccctcatgctgctctcatgatagtgagtgagttcttacaagatctgatggtttataagtgtgtggcagttcccctgccctgcctgccatcttgtgaagaaggtgcttgctcttcctttgccttctgccatgattgtaagtttcctgaggcctcccagctatgtggactgtgagtcaattaaacctcttttctttataaattactcagtttctggtagttctttacagcagtgtgaaaatggaccaatactctcttcctcttcccttattccctcttttcctcccaaattatggcaaccattgatctttctactaccaccatagttttacccttcccagaatgatatttactaggaatcctagcatatgtagacatttcagactggcttctttcaagaagcaatatatgttaaggtctctccatttcttttcatggcttgaaagcttgtttcctggaagctattccattgtatggatattccacagtttatccattaacctattgaaagatgcatcttgtttgcttctaaattttgacaattatgaataaggctgctataaatgttagtgtgaagactttgtgtagacattagttttgaacttatttgagtaaatacccaggcttgcaattgctgaattaagaccatatttatctttgtaaaagcataccagactgtcttccagtgtggctgttcttgttttttcactaaaaatttatttatataatttatggcatacaagtgcaaatttattacatgcatagtagtcaagttaggggattcagagaatctgtcacccaaataacatacattgtacccattaagtaatttcttattatatacccctctcccactctctcacccttctgagtctccattgtctatcactctgctctctatatctatgtatacaccattttttagcattcactaaaaaatgagtgagtgacaacatgtgatatttttctttctgtgtctggtttgtttcacttaagataatgaccttcagttctatccatgttgctgcaaaagaccaatgctttggctatttggactcttttttggttctatatgaattttatgattgttttttctaattctgtgaaaaatgatgttggtattttggtagggattgcattgaacctgtagattgctttgggcagtatggtcattttaacaatattaattcttctgatccatgagcatgagatatctttccatttgtttttgtcatcttcaatttctttcatctgtgttttatagttttccttgtagagatctttaacctctttggttaaatttattcctaggtattttattttctggtaggtgtggtaaataggattgacttcttgatttcattctcagtgagatcattattggtatttagaaatgctactgtgttttatatgttaatttttgtatcctgaaactttatcaaatctaagagttttttggtggagtctttaggtttttctagatataagatgatatcgtcagcaatctgcgatactttcacttcctcttttttgatttggatgtgttttatttctttctcttgcccgattgctctggctaggacttccagtactatattcaataacaatggtgaaagtgagcatctttgtcttgttttagatcttagttggaaggccttcagcttttccccattcagtatgatacatgggtttgttgtatatggcctttatttttttcaggtatgttccttctatgcctagtttgttgagggtttttttaccatgaagggaagcttaaccttatcaaatgcattttctgcatctattgagatgatcatatgttttttgtcctaattttgtttatgtgatgtatcacatttattaatttgcatatattcaaccatctttgcatccttggtataaaacccacttgatcatggtgtatgatatggtttggctctgtgtccccacccagatctcatcttatagctcccataattcctatgtgttgtgtaagggatctggtgggagatggttgaatcatgggggtgggtctttcttgtgctgttcttgtgacagtgaatgagtctcatgacatctgatggtttcaaaaacgggaatttccctacacaggctctttgcctgccaccattcatgtaagatgtgacttgctcctgcttgccttccacaatgattgtgaggcctccccagccatttggaactgtaagtccaataaacctctttgttttgtaaattgcctagtcccaggtatgtctttatcagcagcatgaaaatgaactgatacagtgcattatctttttgatgtcctgtattcaatttactagtattttgttgaggattcttgcatgtatgttcatcagggatattggtctgctgttttccttttttggttgttgtgtcctcgtccagttttggtattagggtgatagtggcctcatggaaagaattagggagaatactctcctcttcaattttttggaacagtttcaggaggagcggtattccttctttttatatttgatagaatttggctgtgaatccctcagccaagctccctcaacaatccctgagcttgtctttattgggattttttttttttttactactgattcagttttgctcttcattattggcctgtttagattttctatttcttccttgttcaatcttggtaggttgtatgtttccaggaatttatctctttcctctaggttttcttgtttgttgagtatatagttgttcataatagtttctgatgatctattgtgtttctgtggtatcagttgaaatatttccttttttatttctcattgtgtttatttggttcatctctcttctaggttagtctagctactggtttatcagatttatttatctttttgaagaatcaactctttgtttttttaatactttgtatttctttggtccctatttcatttagttctactgtgatctttgttatttcttctgctagttttgagtgtggtttgttcttgattttctagttttttgagatgcattgttaggttgataatttgtaatctttcttttttttgataataggcatttaatgctacaaatttccctcttaccactgcttttgctatatcccacaggttttggtttgttgtgtttccattttcatttgtttcaaaaaatttttaatcttttgtattaatttcttctttgatccaatgattgttcaggagcttgtgtaatatccatgtgtttgtatcgtttctgaagttcctttttgtattgatttctatttattccactgtgttatgagaaaataattgataggatttcatttttaaacatttgttgatacttgttttatggcctaacgtggtttatcttggagaatgttccatgtgctcatcgaaagagtgtatattctgcagttgttgggcagaatgttctgtaaatttgttaggtccatttggtgtaaagtccaatttatatctaatgtttctttgttggtttcctacctggatgatctgtctaatgccgtgagtggtgcgttgaagtctcccaccattattgtatctgtctatctctctctttaggcctagtgatatttgttttatggatctgggtgctccagtgttgggtgcatatacatttaaaattgttatagcctcttgccagattgatccctttattacagaatgaagttctttgtcttttttaaccgtcttttatttaatatctgatttaattgatgcaagtacagctagtgctgctcacttttggattttgtttgtgtggactgtctttctattcctttacttttggtctatatgtgtctttacaagtaatgtgagtttcttgtaagcatcatatagttggattatgtttttaaaatctattttgccaatctatatcttttaaatggggcatttaattcatttattttcaaggtttatattgatatatgtgagggtttgttcttgtcgtattgttaattgttttctagttttataaattctctgtttctttttcttggaatgtttgcctttggtttggtggaattctgtagtggtgccatttgattcctttttcttcctcctttgtgtgattactttaccagtgagttttatacttttgtgtgtttttatgatgatgaatatcgcttttacttccacgtttaggacttctttgagcatttcttgtagggccagtttagtggcgatgaattcctcagcatttgcttgtctctgaaagacttcatttcttcttatttatgaagcttattgctggatattgagttcttggctggcagtcttggttttttttatttcagcatttttaatatgtcattcccttctcttctggcttttaaggtttctggtgagaagtctcatgttagtctaatggagtttccttatgtaggtgacagggtgcttttctcttgctgattttattttattttattttttctgtgaagctgttctttatttcagggagaggacaggacagggagctcagtctttcatagcagcaactttcctcgtgatggccaggacattgctcagctcctcccgcttcctcttggtgtggatgtgtgtccccacccttttcttgatgaacttgagggcttgtttgtccttggagaccttcagtaactccatggtgcaccgctcgtatggggtgaagccacatacctcttggatcatgccccgcacacacttggtgtgtttggtcgggcgcccaaggctacgactgtgtctgggcttgctcaaattcttggtcaacttgtggcccttgttgaggcccacgaccatagtgtagcacagaaccattgctgctgctctgcaatggtggctgtggtggaatgctgtcttgctgattttagaattctttttactttagacagtctgattataatatgctgtggcaaactcctttttgcattgtgttttcctgggaatcactgagtctcctgtgtctggatgtctaaatcttgctatacttggaaaagtttcgtttcttattttgttaaataggctttctaagccttttaatctctcatatccctcaggaataccaataatttgtaagtttggtcattttatgcagtctcaattggcacatgtatacctatgtaacaaacctgcatgttctgcatgtggatcccagaacttaaagtataataaaaaaataaaataaagcaataagcaagttcaaaaaaaaaaaaaaagaaaaagctttgttcattctttttctttatttttgtctgactggattatttcaaaagacctgtcttcaagttctgaaattctttcttctgcttgatctagtatttcaaatgtattttgtattttcttcaatgaatcctttagtttcggaatgtgtgtgtgtgtgtgtgtgtgtgtgtgtgtgtgtgagagagagagagagagagagagagagagacttgttctgttgcccaggctggagtgtagtagagagcgagagtgagagagagagagagagagaaagagagagagagactttttcttttgcccaggctggagtgtagtggtgtgatcatagctcagtatgacctcaaacttttggactcaagtgatcctcctgcctcagcttcctgagtagttgggattacaagcatgtgccaccacgcctagctaatatttgtatttttagtagagacaggttctctctatgttgcccaagctggtcctaaacacctgggctcaagcagtcctcttacctcggcctcccaaagtgctgagattgtaggtgttagccaccacactcgggctttttatcttttaaagatatttatctccatgttataagtttttatttgtattctgaattgattttctgagttctttgtattggtttttagatttctctggcatctcattgagcttctttaaaatcaatgttttgaattctttatctgggattttgaggatttttttttcttttttggttaggatctactgctggagaattattacattcatttgaggccataatattacttagctttttcatgttttctgtatctttatgttggtttctgctcatctggcttcatagttacatctttttaaaaaaataactttcacgtggatgggggacttttttcttgaagatatgacaatgatgttcgttgggtaaggccttctggctttgcttccaggtgcatgcagtagtgaagactctgtataatttgtatggctatccttattctgttaatgtgttgttcttggtggggcctgtggtgaagttgtgcttgtgactggaatgcctgatgggcccatcatcaggttgtaatggtagcagaggtgtgctaagtatgtctatccttgtgacctgggacagcatatgctggctcctgtgttggcagtttccaggcaggctcatgtttgggcatctgggtggcttcctcagatgccagttttagtagcagtataccaggcagataagcaggctctcaagctcctgagcagttggagtagtgtgggtgatagaggtagcagtggtggtgagatagtctccttgttcccatgcactgtgctcttgtgttggaagtggttgcaacaggctgtgcaaactggcttctaggccagaaggtggtgctttcaggtaagagccagctgagactgtagaagcagggtgtttatgctcagtctctgtccccttggtgctcatgtgcccctggtggtagattgggttgtggaacacccagaacctggcccccacagttcatgttggcatagggttaggagggtgaagctgggtggatccagactgggcaagcttgtactcaacacctcccaatggcaagtgcgtgcatgagccatgatgtgggggtggggcaggcagtgtagtcgtcatgcccctggtgaaatgcttgggtgagaggtgactgctgctgtgctgaggtcctgccatgggtgccagggaggatgagaccactgctgtccctccctcatcccatctgtggcagccaacctggctgttctgttagtatggcagtttgcacccagcccataattcagccatgagccatagaagccagcacccagctcaagaccaagcctctgcagtaactcatcctgctcaggattggagcattgggagcctggttccagtgccagaggctggagcccatgccatgtccgtttcttagttttgattgtgggattccccattgatccccattcctgctcaagcccctgctccacaagatgcaacctgatcttccccaatggccaagactggtgctgcagattcccaggaccactcatagtttgctaagagctaggattaagaatcgcatcttactgtggctacttagttctcaggaattgtgtgggacccagggcatgttgcctccttgaagcagttccttctcacagtctcttggatgctccctaaatcagattcaggatttgggtgggtcagggtgctctgctgtggcctggactgtatgattccccagtgggaaagtggactgcagaaagatactcactcactctctcttagggattcattgccagttcccagccggtcttgaccacgacaggctgtctgcttttcttctcattcccagattttggagtttcctttcactttttctgttgaaccctgtgttccctgttgggtaatgtattcaaagtgtgattgtctacataccactttggtttttctaagtggatgaggtgtgctggaaatgtttttagtcagctatcttggaaaacaaaggtcatcctcctgtcactttttgaacttctttggttactgtgttttctcatgactattattttcagccttctctgcttgctgttttttctctactcactaagtgttggccttcctgatagcccattcttgatctctctaattcaatactctgatattaggtgatgccttccatttctgtgatttaatagaactaaccatattcctacaactttcaatttttttttttttgagatggagtctcactctgtcactcaggctggagtgcagtggcacgatctcggctcactgcaatctctgcctcccgggttcaagcaattctcctgccttggcctcctgagtagctggaattacaggcgtgcgccaccacgtctggctaatttttgtatttttagtaagagacggggtttcaccatattcttcaggctggtcttgaactcctgaccttgtgatccgcccacctcggcctcccaaagtgctgggattataggcatgagccactgtgcctggccacaactttcaattttatatatccatcccagacttcacttaggagatcaagattcatctgtctaatgcccatttaacagcccctctttgagtctctctcagatgtctcggtttatacagatataaacttgaacccttcattgcacctctgtttcaaaaaagcaaaaacctcaccagtagaagaagctacaaaaatcctgttacactcccactgtttattagatattattattttagctgtccaggccagaatcctgggtgccattcttgattctttcctctcatttcttccacatacctagctctttgccatcccctatgagtactaatttcaaaatatatttcaaattttatccattttctcttaaccctattcttgcaatcttaatacaagttactatcgtctaatctctgagaccactatattatttatgagtacttaatactaggtattatacagaataacaaactgggcatgattttgtttttaggatttcaaattacttgtaaacagtaattttgaactcccagaattctgaagttacaagaataagaggtaaaaccctaaatataaagaaacatatcctaaactaaaaacagtgacttcactttcttccccaatagaactgtgtgatgcttgggtatccagaggaggtaagccagaatattgggaaacatttatttctagtttagattttggtttctagtaattctattgtttttttagttattcagaattttatggtgggaggaggaagaatagaaattttcatattatataaacatagctattttttgccagttatacaattttacataaggttaagaatgagaatatatatctctctccttctctatatgtatctctatatattacatatatagtaatgcatatgttaatgttctgaataaggaatttactatattgctaagtgaataggcctcatcccttggaatgaggaagttgagcattactgagaggaggttgtttttatgagggcagaccagatgctaaatgaggtacattgagctaggctggatgctcttcctgacagaggcacaaaattttcttacatttttaactaaataagtatgagctagtgtgagcaaagtaaatttctatgataaggtaactaacttgatagttactcaggtagtttttgggggtttgcacctttggggacattatttgtctgccatgaatagaggttgttgctggcatctagtgggtagatgccagagatgctgctaaatatcctacagtgcccaggatagccccctacaatggttatccagaccaaaaaggtccacagtggtggggttgagcaactctcttctagagtatttatttttcaacccactgctataatgtcctaagtatttttcaaaatttcatttaacaaataaacccttaataggagtaatggttataacgattccatgattttatttttgtgaaaatttaaatgaatggaagtatatttgtgtgtacttgcaataatttaggagaggaatgaatcaaggatgaataccaggtttctggcttgagcaactcaccaggaggatgttgttgacattgagatgagaaaaaaaaaattgtgggaaaagatcttcatttcagatgttatatttgtagaatttgaggtgcctgagagatatcaaggtgaagtcctgaagatcagaacataggcttttagacatatccttaatttgcaattcatcggtatgtaaatataatttggatctaggttggatgaaatcacccagtagagtatcttttttttttccatttacttttcagatttactgagtgaacataatttttcataaacatttgatctaaatcatttttgttgttgttgttgctggttgtttggtttttaatactgggaacacagagattcagtttgaaagataccctaaaatcttaagagtagtatacaccaatccctcccactctccacccacaatctagttggtttaagtgagcagaatgatccatttttccattttaggtgagcagatgtttatgaaagatcttagaactgtttgcctcatttatcaggaacatttacaagggaagaagccattaatcgtatttcaacttgtaaatagaagaagactaagactcaggttcatatcttatacttttaacaagaacttgttgaaagaaacattaacaatttcaaactaattttaagtttttcctcacaaaagcataaaaatggagatcttaacaggaaattcttaaaaggtaaaaacaactcctacttatactagtccttgggtagttaacatagaacaggttcttctttttgtttctttgaaaaggaatttttgggcccaagtctgttcctgcttagtatctgctccggccttcccccctctcgaagcggcctccttgacggcctccgcccctgggcaccctgcagcctgaccggctgtaagaatcatgcaggggagggctgcccgtttccatgggcagagggagcccacgatccggtctgcctacccggtctcgacccctcgagtagcggtcgctccggccgtaactgttgctggatctgtcgtggtcgccgctgtaggcgtcaggcaagctgccctggtactcctcgtagtggcctcctcctccgtagcggtcgctcaggccgtaactcttgatggaactgtcgcggcccccactgtgggcgtcaggcgaggggcctcggtactcctcgtagcggcctcctcctccgtagcggtggctccggccatgactgttgttggaactgttgaggccgcggcccccgccgtaggcattgggcgagcggccttggtattcctcgtagcagcctcctcttccgtaatggtcactccggccatagctgttgctgaaactgtcgcggcccctgctgtaggcttcggtgtagtggtccccgctgtgggcatcgggcgatcggcccctgctgtgggtgtcgtgcgagcggcctcggtactcttcgtagtggcctcctcctccatagcggtggctccggtcgtaactgttgctggaactgtcacggcccccactgtaggcgttgggtgagtggcctccgctgttggcatcgagagagtgacctcggttctcctcgtagcggcctcctcctctgcaggggtcgttccggctggaactgttgtggcccccgctgtaggcattgggtgagcggcctccgctgttggcatcgagcgagcggcctcggtactcctcgtagcggcctcctcctccgtagcggtggctccggctggaactgtcatggcccccactgtaggcgtcaggcaagcggccactgctgttggcatcgagtgagcgacctcctcctccatagtggtcgctctggctggaactgtcgtggccccggctgtaggtgtcaggcgagcggcctccgctgttggcatcaagcgagtggcctcggtactcctcgtagcggccgcctcctccatagcggttgctctggctggaactgtcgtggcccccactgtaggcatcaggcgagcggcctccactgttggcatcgagcaagcggcctcggtactcctcgtagcggcctcctcctccgtagcagttgctctggccagaactgtcgtggcccccactgtaggcatcaggcgagcggcctccactgttggcatcaagggagcggcctcggtactcctcgtagcggcctcctcctccgtagcggtggctccagctggaactgtcgtggcccccgctgtaggcattgggcgagcggcctccactgttggcatcgagggagcggcctcggtactcctcgtagcagcctcctcctccgtagcggttgctctggctggaactgtcgtggcccccactgtaggcgtcggcagagcagcccccactgtgggcgtcatgcgagcggcctcggtactcatagcggccttctcctccatagcggtggctctggccgtaactgttgctggaactgctgtggcccccactgtgggtgtcgggtgaacggcctccgctgttggcatccagagagtggcctcggttctcctcatagtggcctcctactccgtagcggtcgctccagctggaattgtcgtggcccccactgtaggcctcgggcgagcagcctccactgttggcatccagcgagcggccttggtactcctcataacggcctcctcctccgcagcagtcgctccagctggaactgtcatggcccccactgtaggcgtcgtcggaccggcccctgctgtgggcatcagtggagcggcccccgctgcgggcctcgtgtgagcggcctcggtactcctcatagcggccttctcctccatagtggtggctctggccgtaactgttgctggaactgttgcggcccccgctgtgggcgtcgggcgagcggcctctgtactcctcgtagcagccttcttctccgtagcggtcactccggctgtaaccgttactggaactgctgcggcccccactataggctttgggcgagtggtccctgctgtaggcgtctggcaagacgactggcaaggcctcggacgagcggccttcactgcaggcatcgggcgagttgccctggtactcctcgtagcggcatcctcctccataagatggcggtgtcccccacacaggggcagcgccgcatgggcctccgtagctcttgaggggctctcggtaggagcctttgctgggatgatctgtgtactcatggtcgcgacccctgtagccattttggttgccgtcgcctctcaagggacggtagtccgggacactggagtggccataatagcggcggctgtagtctctgagcgcagggacaaaatccccagggtcgcggcacgggggcagtggctcccggacccgcgggcctgagtagccatcttgcccccacacggccggggccttcccaggcattccactgccgccaatgcgagccaggcttgaccggggcacagccctcttgtggggtgggccggcccagcgccgtggctgcaagcctgagtagccatcttgccccgacacagtcggtgccttcccgcgcattccacagccaacgctgtgagccaggctcgacggcgtggccctcttgtggggtgggctggcccagtgccgcggtggcggcccgcgcttcctgggcatcggggccctgtagggccacaggtcgaaataccccgcgtagccgcggccgtcatcaggcctgccctgagaggggggtcgctgtgggctgctgccacccccacgggttctgtgtgagaaccttgagcgactgccgctgccgggggttggcgggacccatcggctgctcttgaatgccggtttgatggtctgggccaccatgatggccttaccatccaggtacttgccgttcatatctctggcggcagccttggcgtctgcagggctttcgaaggtgacgaacgcgaagcccctcgacttgttggtttttcggtctttcatcaggaacaccttgatgatgtggccatacttgccaaactcggctttgagggctttctcgtcggttttgaggttgaggcccccaatgaaaagcttctctgggcgatccgcttccatcatgtctccctgccgaatggtgggtcagaggaagtgggaagtgatgacgcggcagttcagtcgcggccttcgagcgctctcgtggagggcggctcctaccggttgggggggtggatgtctcaagaaggaaaagagtaccttacgtcatagttcttgggaacaccaacgtctatgatacaggtagaggaaatcctaggaatagaaaataagaagtagccagagaggtaggaagagatcccagaagtgtagtcttctaagccagaggaaaataatctttccagacatatggaatggttattgatatggtggttgttggttacattggtggatgtgagagtggatagaaaccaaattgcagtgggttaagaagtccatggtaagtaagaaatttagttgtgttgtgggtttatgtgagtttggctgtaaaagaagaggcagatggagggggttgtgggatcgtgggaggtatttttgtgtttgcttttaaagatcagagataattcttcgttggtattttaaaagacaaatagcatatttggaatttaggtatactgaagcatatcaaatacatctggttaataaacatgcgttctatgaggtttttttctttttttgagacagagtctcgctctgtcactcaggctggagtgcagtggcgtgatctcagctccctgcaacctccgcctcctgggttcaagcgattctcctgcctcagcctcctgagaagctgggattacaggggcccaccatcacatccggctaatttttgtgtttttagtagacacaggatttcgccatgttggccaggctggtctccaactcctgagctcaaaagatctgcctgctttggcctcccaaagtgctggtattacagatgtgagccaccgcgcccagccgtatgagtgtatttctaaatgatgttttttgccttcaaggtattgatggataatattgtatattttaaagtattttaagtagttgcttagattctaagtgattcagcaagtgtgaaaatagttcttttaattaccatagatataggtatatgtttaatactcactattttcttttcagatctttccagaaatcgttttacagaaattccttctgatgtctggttatttgcaccccttgaaacattaaatttatatcataattgcatcaaaaccattcctgaagccattaaaaatctgcagatgttaacataccttaacattaggtaaggaaacaatttaaaaataaattttggtttttattgttgttctaatccttttttagtcgcaaaggaatatgtttgatttggctgtgtagcttaaatttatctcaacagtatcttatttgtgttttttatatgttcacattattttgtaggcttttgtcttgttcttgagagcagagcttagcaaactttaacacacaggaattacccggggatctgttagaatgcagattctaatttcttaggtctgttatggggcctgcatttctaacaggccccttggcaatgctcatgcctacctgctggtccttagacctcagtttgagtagcaaggctttagaccataaatatttcctgaaattatagcaccacgatacagattttatatgcatccttagatatgtgaaacaaacagtgcttgagttattttttctcacttttgtgacttcttgcttctacttcaaggatggttagagtggggtgagaatgttgaaaggtttggaagtggatgacagttcatgtttatacttagtaagtgcttaccatgtgccaggcagtcagtgttccaaacgctttacccatattaccttatctagttttcatgacagcattttgagataggtaccattgttatccctgcattacagatgaggaaattgggttaagctatttgtccaaattcatagatatattcagcaagtggtagagccaagattaaaatcaaagcagtctggctatagagctctcattcatacatagcttttaccctatatatgtaaaagaatgaacactcagtaagtataagaaaaaaactttccctgccaaatcagtaacattgaatgaaaattgatatattgtgacttaattttagaatttttttctttttttattcagttggaagggataatctcctcattaaccaagttacttgtctaaattcccatatagagaagtagtaaatataattaatatacataaatgataatgttcccttctcactgtgatatatcagttcttttgtatgactcccccagtggtgttacctgacagtacaagctattttaactgaaaccactttacaccttaaaatgtgtgagagaagtttcctggctgggtgcggtggctcacgcctgtaatcccagcactttgggaggccaaggcgggtggatcacgaggttaggagatcgagaccatcctggctaacatggtgaaaccctgtctctactaaaattacaaaaaattagccaggcgtggtggtgggcgcctgtagtcccagctactggggaggctgaggcaggagaatgatgtgaacctgggaggcggagcttgcagtgagccgagatcgcgccactgcactccagcctgggtgacagagtaagactctgtctcaaaaaaaaaaaaaaaaaaaaaaagtgtgagggaagtttccttccaaagatatcaatcatttgggttgctcctttctctaagtaggtataaatctccttggcctggcttaggagaggtttgaggaaagtgaggtatttttaagttttgtctttgtttctgtttcattttgttcttttgcggaaaaagtgattcgccaaaaactgaattacacttctctattaacacatatggtaatcttagttttactaaaactttctctgattctatcctgtcacgatctgtaaaagtcaactttgatctttttttacagtcacaaaaatttttgagcaaactatattgaaataacatttgttctagtgactgaattcttctctaaggcatgtagtaaaatagtgacaattaataatttatttgccggtattaagaaaccagattctggtgaaagatgattgtgttaactcaatgaatatgcatttttttttttttttttagacggagtcttgctctgtctcccagggtggagtggcaccatcttggctcactgcaacctccgcctcccaaattcaaatgtttcacctgcctcagcctcccaagtagttggaagtataggcgcctgtcaccaggcccgactaatttttagtagagacagtgtttcaccacgttggccaggctggtctcaaactcctgacctcaaatgatttgcccgcctcggcctctcaaaagtgctgggattacaggcgtgagccattgtgaccggcctgaatatgctttttaagggaagaaaataaattgatttttaagctatttttggcctgaagatgtattagaatgagtttgccattatttcttccatgtatttatttattttggtgaaaatctcttaataaacttgtaaaataatttttcaactcttctctcttcctatatactacccccctttttcagtagaatcctgtagaaagatccttgtgtgccctggtatgaagggacccagactgaccatttttccaaggagcctgcttcatcctgaaagtatgaaggattatgacaggaccctagcacatttgacattccagcagtctggccattattgcttgttgaggggcattgccatttttttgtttgtttgtttgtgccgtgttattaaagccagtctagtatttctggatgtcctttgccagagaaaagatggggaggagggtctttcaagtcccccttgagtaacactggacttttgttgctgtgtatgttacacgaaatgctaggtataggtctataaatgacactttgaaaaacaggaaaaataatagcttatcgcttaccagtgcttgttagtatgtaaatggaatggaaaaatatacattttgttagtggttcctttgggtcagtcagtctgttttggcatataaatttgaccatagtactttgagggcaaagaccccagagccagattgcctgagtttgaatcctgcctctcccatttaacagctgtgtgactttgagcagtttacttaaactctttgtgactatttcttcatctgcaaaatggggatcactgtgagagttaattcacatgacctgctgcaaaatgaggatcactgtgagagttaattcacatgagctgccctgaacatggcctggcaatagtaggcactcagtaaatgttagttattatatttaaatgtatctacagagataagaatgttttatcaactttgagctgagataaaggtgctaataggctgttaaaccttaaaagggaatgggttagggttactacatgtttttgaagatatagtcctattcactcttttataaacttaaacatagtgcatgcacatttatccctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacactttttagactgaaataaatggtaaaaggccattatatgcaattgattgtagaaatacagaataatttaaattaattaccttggacataacattttaggtattaaaggacattgaattctgagagaaacatattcagagcctcgaagctttcagctatttttcatatcttctggttacctccactttacgcagtataccatgcttcatgtttttcttttattttgaatgatgctttcctaataaacaggtatttttaaagttttttttttgtgatagagtctcgctctgttgcccagactggtgtgtagtgacatgatcttggttcactgcaacctccgcctcccaggttcaggctattctcgtgctcagcctcccaagtcgttgggattacagccatgcgccaccacacccaacttatttttgcatttttcgtagagatggggtttcactgtgttgcccaggctggtcttgaactcctggcctcaagtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttccttttagttaaagtctcacttaatgttgtactaaaaaatgaacagagattccagatatgatctaacaagttcataataaaaggtaccattattttgtttgacttgaacactattaatgtttttccagattttataaaggttataatttaagattttatgtctccgtaatttatttgtttttaatttagtttttggccctacgtttttaattacattacatgatgtaatttttagataaatgaaatgtaaaaaataattaggagttttatattaattctagtacagttgtccctctatgggggattggttccaggattcaccccataccaaaatccacgaatgctcaagtctcttatatacaatagtaatatttacatataacctaaatacattctcccatatactttaaatcatttctagattacttataatacctaatacagtgtaaatgctgtgtgagtagttgttacgttgtattatttaaggagtaatgacaagaaaaaaaagttaatatatgttcagtacaggcacaaccatgctttttttttcctgaatatttttgatttgtatttggttgaattcatggatgcagaacccatggatacagaggaccaactgttttttaatttatgtagaaaattctaaaatgtttaacactattattttactaggtactgtaaaattattatgctttaaactcttgaaatcagtaacagtagatgggtagatagcattaggagggctaattgacagttgtaaatcacatattgaattggtggatattccctgtcattggaatattttctcttgatacttttccacatcatgtgataatcaactgcaatgaaattctgtcattagaaacctaggaaatactctctggcttccaatcctttgcagactattttgtagagcacccactggagtgggttcatttcctatgcctgggtttatttctcttgggaaatgacagctatctctcaaatttctatggattttccatatggaaatcataagtatcaaatacctttagaaagaagcaataatgtttaaataacattttcacaaacttctattatccatcgtttgaatagtagtctattctgaacatagcagctaaggtgatcctgtcaaaatataagtcagatcatgtcaatcccatgttcaaaagtttctggatcctgcccacatctctcagaataaaagctaaagtcatatccctccctctattctactctctcccttgcccatttccctctagttacactggattccttgctgttctttgtacctgtcaggtgcgctctgcctgagcgccttcacttttattgttccttctgtctggaatattcctttcttatatattagtatggttcaccttttagctctgacagtactgctcaatatcaccttctctatgagataaagtagtatccctccccactattgcgagcatagccattttcctaccctgttatcttttttaaatagcacttatcaccttctagcatattatataatttactccccttgctagcatgtaaactccatgaggagctatgacagcaggaaattttgttttgccccttgataaatccccagtccctggaacagtacctagcaaatgttaatagtattcaacaaatatttattgttgaatgaagatgccttagatattgtttgaaagaggtatgtaggatatattttcctaatcatctatagcattattatattcttccctacatggttttaatattattttgaaaactgaatgtatgtactattctcctccctccaagctattatcattttcactaaaagttggaaattgggggcagttgcattagaatatgaatttcatttgaagtgtgtctggaatgattactgtctgagaccatgttgtagatttctcttttttttgttgttgatgttattataagaaagaggggagagagcacagttaacttaaactgttcttttttctgttttttttaattatgataataaataaaaacctcaatttgttattatggaaacttgatatcgtttgcctttaaattggggcttggattttaaccacagagatttcctgagagacaccttagataacctgagagatttccaactcagatctcttagaatgtctttgagctatgagatgagtcacaagtgttggggcttgtaacttctcattttgtatccctttggagaaagagatttagttaaatcaatctttatcatagtctgtttcgccagtgcacatttataaatccttgactttcttagcttctgcccagccaagtatctcgagacaactactgtaattgacagattacacaatgtttgagagttgttagtcttttactttacctccacgtgaagagtgctggatcattcttacttctggttttggctggtatgagttggcctttagttgagattttcgagaggttgtagttactaagatataacctcaaatttttgtatgggaagtttctatttactgtactaggtcggcttcatgatgtcgtataaatagaaatctgccagataatccatctttagagcaatgacattagaggataacttttgctagctattaaccatgtgctttaatttaaaaattagaatatatatatataatatatgtatttctcagttagcttgttataattctgttttattgttctccttaggatattagctgcaatgagattcaagtccttccccaacaaatgggaaaattacattcacttagagagctaaatataagaagaaataatcttcatgttttgccagatggtaagatgttcactgtttttactcacatgaataagagagtaactatgtaaaatttaattaattatttttcatttctgaccagaattaggagaccttcccttagtcaagctggatttctcttgtaataaagtgaccgaaattccagtttgttacagaaagctgcatcatttacaagtaataattttggataacaatccattgcaagtaccaccagcacaggtttgtaataaaaatattataatgtttcttctcatttttattcataattttatctgtttatgactggtaaatcaaaaagcacctaaatcaagagccaatttgttgttcaagcactgttgtctaaagtttttctgagcattgccttttgcactttggtaggagttttagcttaggctctaggatagcatttggaaaacccagataataactttctgcttgtgaactgataattctggttgttagttatttacaaaagtgactctgaagtctctctacctatttcccactcaggtatatatctacttgggatttgttgtgggattgattggagtacattcttggcactgagagatggaattataacagaaagaacaaaatacaagtggaaaatattaattatgacttttagtttagtgaggattaaatccatgtggaatcctcttaaatgatagttaaggaataaactatgatataatcccctatggacaaagtatgaaagagaagaaagaggacagtggggaagagatgtcaatagaatttctgaaaatggaaaatagaatagtagaaacaagtacctttacttagattgcccaaaattatttggctgaggagcaagtagcagtgaaatggtactttatgctgtgtgccctggcagagggtttgcagacatccagaagaaaggtcttctttttcttcctacaaaagtacattccactcattctaaaggggttaccttttctaattcaaataaagactggctagagtcctggtggtagcaaccttagcagaatgaagaaagctgaaacttgtgcctgctatgggagaaggcaatcagattcaagttgatttacagcgtcaaacctgggaatggcttgagtattggaggaaacatgtaactctgaatatagggattaagtactgaaaacatgatggtttgtggaatgtctaaggcagtgctgtccagtagaactttctgaatgatggaaatgttttataatcgacactggtccaatactgtaaccacttgtttatgtggctgttgaatgcttggaatatagctagtgcaactaaggaaccaaattttaaattttattttaatttgatttatttaaatttaaattgctgcatgtgactggtagctcccatattaaacaccacggctctaagatttacaccctcagattcttgccctcagccccacagccacagaccattccttacttgcatcagcagaagtccggaatttattctaaggagtaggtagatccttaggttttctccgttagctcagtggccagatgatgactcacttcttgcctcagcagaagactggtgtttactccttagagaagcaccatcccatttgtacttgctgtggtgatgagcatgttctgtatctgcattgtccaatacggtagccatagtggctactgagtacttgaaagtgtatagtgtgacaaaagaactgaatttttattttatttagatttgattaatttacatttaaatacacatgtagaacacaaaaccaaacaccacatgttctcactcataagtgggagttgaacaatgagaacacatggacacagggaggggaatgtcacaaactggggcctgtgggggtgtggggggcaaggggagggagagcattgggacaaatacctaatacatgcggggttgaaaacctagatgatgggttgataggtgcagcaaaccaccatggcacatgtatacctgtgtaacaaacctgcacattttgcacatgtatcccagaacttaaagtaaaataaataaatagacacatgtggctagtggtaccctattggacagtgaagctataaagggattgaaacagagtcaggggctccaggtacagcttatatagcaagagcgagaccgcatactgaaaacagtgaatggttgcatactgaatgttgagacgctccagtttggctcccagaatgcttgcaacctgtcttacatatttcaggcagaattggtggatttcttccttagtaaactgcagcaggagaagagacctatctatatactgaatttttggagtcacctgatgaaatggctagtctgtgtctgatcaccagatagatggaagctcaccatcaggaaacttccccatgcacacagagcttccagtttgttttttattatcccttttggaaattaacagacaggtcggatggtagctcatgcctataatcccagtactttggaactttggtagactgaagtgggaggattgttagaacccagtaggttgaggctgctgtgagccctgatcacaccattgtaccattgtactacagcctagacagcagagtgagactctgtctttaaaaaaaaaaaaaaaaaaaaaaaaaaaggctgggtgcggtggctcacacttgtaattgcagcactttgggaggctgaggcagatggatcgcctgagctcaggagtttgagaccaccctgggcaatatggtgaaaccccgtctctactaaagtacaaaaaattagctgggtgtggtggcacgcgcctgtagtctcagctactggggaggctgaggcacgagaatcgcttgatccttggaggaggaggttgcagtgagccaagatcgtgccactgcactccagcttgggctacagagtgagactctgtctcaaaaaaaaaaaaagaaaaaaaaagaaaaaagaaaatgaacagccagccaagaatcattagacattgcaagagtaatctctaacatgaaagacagagaccaaaacaccaaaggctttcattgaaacgaaagggagcacatttattttttgtgtgtgtgtggatatccagaaatatttgtaaaccatatatctgatgaggggttaatagccaaaatacaaaaaggattcatataactcaatagcaaaaaaaaaaaaaaattgaaaaataggcaaaggacttgaatagacattttttcaaacaagacatacaaatggccaacagctatatgaaaagatattcagcattcctaatcatcagggaaatgtaaatcacaaccacaatgagatatcacttcacacttgttaggatgcctgttatcaaaaagaaaagataaccagtgctggcaaggatatggagaaaagggaaccattgtacactattgatgggaatgtaaaatggtacagccattatggaaaacagtatagtgcttcctcaaaaaattaaaagtagagctaccatataatattacagtcctacctctgggtatacatctgtaagagatagaaaaataaaccaaactattttttctattttaattctcaatacagaatacttcacttctggtcaccaaaatgcgtcagatttcttcccaccaccaagcagttctccagcagacactgactgggtatcctataattcaattcaattctgacactacctggagttaacatcagatcctacaggttaagagctcagtcccacagactgctcacctatacttctgactgaccaactataagttaaggttcccatgaccccctcctcaggttcagttaatttactagagtggttcacagaacttagtgaaacactttacttactattgctaatttattacaaaggatacaaatgaatagccagatggaagagaaggataggacaaggcatatgagaaggggtgctaactgaaggggtggagaggggatgttccctttcctccccatcataagggtcacggctgatacccctataacaaaaaacaagtaaacaagataaaaggataacaactttatttgatcatagttttacgtgacactggagccttcagaataaggacccaaggatatagagaaagttagctgactttatgcttcgattcaattcagactgggacagcagtgtagaaatgtgattggacaaaaaaagcatgagctaatggtaatagatggagtgggaaaacctagcaaggccttttcttggtgtctctgttgtagcgtttgttccttctgggtgtagggtaatacttctctggaatgagggttttaatttgtttatggccagtggttacacagaaaggtaggggaaggttagattaggctttatggctggctttggaaaaaaggggttctagtgcctatgactggccttggggacgataaattcttgtttccatgacttgcctctagtgagaatgaggaggtgagagacaggggaggggcgtctggagaaggtcagagaaaaactttgcttctgaggctttcattttggggtatcattttctgaacctcaatgaagcttttgtgccctctgtgggcacgccaccttccaggcacctccacgtgtttagcaatttgtaagctttccgaaccctgtccttttggtttttatggaggcttcgttgtggaggcacaattggttacatcattggccattggtgatcacctcaactttcagcccttctctggttcctggaggtgagggaggtaggattgaaagtttcaaccgcctaatcccatggttggttttcctggcaatcagtcccttatcctgtggctatccaggagctcccagccaccagtcattcattagcatgcaaagggatacttaccacttaagagatcgtgtaagagttttaggagctgtgtataggaaatgggagcaaaaccaagtatacattccttacaaattacaatatccgaaggaaatgaaatcaccatcttaaagaaataatctgcactcccatgttcattgcaacattattcactacagtcaagatatggaaacaacctgtatgtccatcaacagatgaatggataaagaaaatatagtgtgtgtgtgtgtgtgggggggggggtgtgtttgtgtgtaatgaaatattattcagccttagaaaaagaaggaaatcctgtcatttgcaacaacatggatgaaacttaaggacattatactaattgaaataagcctgacacagaaagataaatgctgtgtgatctcacgtatatgtggaaccttaaaaaaaaaaagttgaactcctggtgacagagagtagaatggtggttaccaggggctggggggtgtggataaaggggagattttaaacggtaccatccttcagttataagatgaataagtactgaggacctaatgtatatcatgctgataatagttaataatattgtatttacttgaaatttgttaagagagttgaactgaagtgttctcactacacacacaaacaaggtaactacatgaggtgatgggcatgttaattagcttgactgtggtaatcatttcacaatgtataatacagttgatccttgaacaacatgagggttaggggcatcgaaccctgcatactgtaaaaaatccatgtataactttggaatcacaaaaaacttagctgctaatagcctactgttgactggaagccttatcaataacaaacagttgactaacacatattttatatgttatatgttatttactgtattcttacaatcaagtaagctacagaaaagaaaatgttattaagaaaatcataaggaagagaaaatatatttaccattcactaagtggaagttgatcatcataaagatcttcatccccatggtcttcacattgaacagggctgaagaggaggaagaggaggggttggtctagctgtctcaggagtggcagaggtggaagaaaatccatgtataatggacctgcacagttcaaacttgtgttgttcaagggtcaactgtatatcaaagcatcacgttgtacaccttaaatttgggagttcagtcagggtggtgggaaaaattatagaagaaaagttatgaagatagttataggaaatagacacaaaccttcttggaaggctgggggggttgcatagcttcagtaaaaagttcagctgaagtcagcctaatcctcttaccttgagttaatagtttaaagtaggtacaaaggaatgtaagggagtttatctaaatagcttgtttactcatgtggccctaagcccaaccttttatcatctgtgagtgcatgattgctctctactcgaggggttggcagtgttaattaccttctagcggtgtttactcgagacctttgtaatttaatcagtactaaataaatgcgaacttccccggcttatcgaggcagatgctgcagactcaggcagcagagccccttagccagactgacaggcaaagtatctgtgtcagtgtacgtctttcatccgtcattgggtcagggtcagcgggatggacatggcacttaaatataaaaaaattttatttgtaactcatactttaataaagctcgaagaaaaaataaagaggaaaaatggagcatattcataggagtgctaatcagcatggctttctagcagcagttgtggaaactggcagatgttggaatgataccttcgaggactaagggagtatttctaacattctacattcaaactgtcatcaaatgtgaggtagaaaaaggtttcaaacatgcaagatcttagaaatttttactcccatgtaccctttcttaggatgctagcagagggtgtactataccaaagtgagggagtaaactaaaaaaaggggaattcttcttgtctgagattgacagatatgcataggcctagtaagcagccagtcagtagtttggagtacaggagttgtctccaaaaaaaaaaaaaaaaaaatagaaagtaagagatgatttgatacgtttgtccacatggagagatgttttatacttctgtcagagtcaagaatgaatttataataggcatatagaaaatttttcaaaagaaaaaatggggccattaattactttaggaaaaacaaaaacttacaggagaaaggaaatgtaatcatattactctgtagagtttatctgtgaatattttcttggtcataataatataaacactagattttgatttagtgaaaaactgtgacatagttataatagcagagatttatatagtatttgctgtgttctagacactgttgaaaatgctttacatatattaactcatttaattcttatgttaaccctgtaaaacaagtactgtcattatcctcattttacatgtaagaaaacagaggcatagaagttaaatgacttgttcaaggtcacattgctagcatgggttagagccaggattcaacctaaggcagtgtgactgcagagtccatgctctttaaccactatgttatacttctgaagagagaagtatgtttatgtgaattgataggaagcggggaggctgggatggtggtggtggtgtgggtaatgtaagaaatccaagtcctcatcttccttagtgatactccaataaatctaccattggaaaatttaaaacaaatagcagtagaagcatgttattaataaatatgagggcaaatagaaattaaactaaaagagtttaaagtgggaatttgatcttagagattgaaataattagaatgggctgggcacggtggttcatgcctgtaatcccagcactttgtgaggccgaggtgggaggatcacttgaacccaggagttcgagaacagcctgggcaacatggtgggaccctgtctctgcaaaatataagaaagattagccgggcatggtggtgtgtgcctgtaatttcatcccagctaatctgggaggatcacttgagcccaggatgtcgagggtgcagtgagccatgtttgtgccactgcactccagcctgggcgacagaatgagacgctgttttccaaaaacaagcaaaaaaaaaacaaaaaaacaaaaaaaaggagaagtagaattgaggattatgtcttgtcagctttgtaattatttttaaatttaaaaactgtgtacatgaagtactatgataaaaagttaaaatttacaagagagtgatttaccagcacttaatttggtaattaagataaatttttgtttagtttggacgtataatagaatactacctcacattttaattttagcacattttagttgatagtatttaatattaataatttataattaatagaaaaatcaatgatatttacaacatttaattggcaatatatttatattctaatagctcaaaagttttaattttccttttaaatgaaatttttcagtggtcaagtcagacctagtatctgttagaattatctaagaaacattcttcctttggacctggaatgataattgctttttaatgttgttgtcttactgttttctttgctgatttttttgcatgtgaggtaagcttatgtgagcccataaaatgttacattttttattagaattttgagaaatatttatttgatgtcacttagtgactgtaattaaccttgataaagctgacttacagttttcttacctctcattttctattgtttttatacagagtatctttgctcacatagtattttattcctcattattcattttctctatggccaacgaaagtaatttcttaggatattattctagttgaattgaccagtgttttcttttattatttcagtctcaccagcctaatatcgtacctttcaaaaaattcatttttcctatatttatattttttatgttagccttctccaggttttatgccaaacatcttagtggttctgatgagattactttaaagaatcacatagattatttgttcttttcttaccattccaatgaatatatatttttcattttttcaaataaaggccacttttatgagttgtaaacttcatattgtttaatagtttgtacattctgcttttgacaagaaaactctagtgaaatatagaaaaattaacttttttcaataagaacagagatggcaatagaattttagttggtatcagtgttgtcagatttttccacctggtgtcagaagtacaaattatttaaatatgcaaagtatcaatcaagattgtgatgtctcaatgtaatttgagactattgaatggtttaaaatgatagatgtcatttatatttggaactatataattaaatctttattttttattgacagatatgtttaaagggtaaggtgcacatatttaagtacttaaatattcaagcatgttgcagaatggataagaaaccagattccctggatcttccatcattgagtaaacgaatgccctcacagcctctcacagacaggtaatgtaacattcttacagtttcatttgatgattgctgtcttctctttttatgaaatatacttattaatcttgagtgttccgaatatatttaggctgattggtccagcactaaaataaataattggctgaagctacatatcaccatcatagaatgaagttctaggatactagaatatttttgacattttctcaatcattaaagttttagtagtaaaaatgtaaatgtttgacattatattacggaaacactaatttctcagcatgtgacaactgttaatttattttgtgatcactgtattgtacatttgtaacaacaagtagaatttgactttgaactgaggttggtggaagagcaagacatttggggagtaccttttccctttcatcatagtctttatgtctggatcaaagatgatatatcataatgacatataatgatatatcatctttgatgaacatctttgatgttctttatgatttcagtgttttgatcctcatgagattttgagatagtagattgaacattctgtttttaattcatcctttcaagatgtagattggtctgaaagattttatgaaagtataaatccatgtaatagtttagaaaataacctagaatggggtgagactacagaaagctagaccatgcccttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaaaaatataatgtgagccacatatataatttttaattttttgttacccattttgaaaaaagtaaaaagaaatacatgttatttgagtatatccaaaatattatcatttcaacatgtaattaatgtgaaaacttggtgagatattttatatgcttatttaatattaaatctttgaaatctggtatgtactttatgtgtatagtgtgtctcgatttggaatggctgtatatggctactggctgcttaccgtattggacagtgcaggtctatagagtgggttgtcagttgtattaatttctcactcacagcctgtattgaactacttagaaaattcttgtatgtgctttccactttcatactcaggctcttggctgtatggttcttactacctagaatgcccttccatgccttgtctgttttgtaaactctttattatacatagataggcactacagtacttacatataatagcttttggagtcagacataatatggctttgaagcccttttatgactcttaataactgtatgtccttgtgtattaatgtctctggtcctcagttttctcatatgtaaaaaagaaaataattacacaggtgctgtcaggattaaatgaagcaatgtatgtagagcacttagtgcaatgccttacccataacatttcctcaacaaatagcttattatcatcattgtcatttactacaaatacatggagtattttgtgcagtgcagtcagatgaattttggctctaatcatggtttaactacttaatttctctgtggccttgtgtaagttatttaacttctctgagcctgtttccatacctaaaatgttaaccatacccacttctacagttgtgagaattaaatgtgtgcctagcaattagttcaataaatgataaacagcaaatgttataatttttccccttgggacgttaacttttgtaagctttatttttttttgtaaaaagataataattataacttcaagactgtaagaattatgtctaaaatatgaggtgcatctaacacagtacataacacagtatagacactcaatgaatgctaacagttattgcctcttcatccacaagactaagctcaaatgccacattcttgagtgatgcctttcctaactttaccgaggagaattagttgaccttttttttttttctcatagcactttgtatttacctttgtcatagtcttcaaaacatttaaacacattcatttttcctctaggctgagagctagctctttggaggcaagttttaaaaatgtattttctcttaagcattcagcatagtacctgatacttggtaggtgattccctaaatgtattcatatacttctgaaaagtacaaaaaaaagtttttttttgttgttgttattgttttttttttttttttttttttttttttagcatgaaactggttttaggagcggaattaaaacatagtgattaccaccagggactttggtgctagataattgagggatcaaatttggactgctggctgcaagttgcgtatccttggataaattgcttaatccattccagtcaaagttttatcatatataaaatgagaaaacaccatcaatttgctacagtttttcacaataaatatgtaatgttttgtcttttaaacatttagcacagttcctcatacataataagtggtcattgtagactgtgtggtaaaattgcaaattaagtgaaaaatactttgcttcctgggtggcatattttgtaaatcagaaatttgcaaggacaaagtgaatttgaaagtattaaagtgcatattcaatactttgtagctttcatttttacatcctctctttattagatgggcattatttatataaataaaacatttttagagccaatgaagagtaaagcatataaattgaagttaaaagatgtttcgaagctctgtgatgaaatttgacaaaccaatgggaaaaacaggtcttccatcaagataatgttctaacaaggcagcctgattttctgaatctctgaggagaaataataggttattgttgacaattgacactatagagtacacgaagggaacaatattgcatgagtggcatgaataaaatgttttgtaggaagagttctgatatttttctcctcatgtccctaattaaggatcttagacatcaaaagtatatattctgtattatctagggaaattttaggtcaaatgtgcattatctatttaagaagaaaatcctaactgctcttaggatttctatttccatagtatggaagatttttatccaaataaaaatcatggccctgactctggaattggaagtgataatggagagaaacgattatccacaacagaagtgagtattttctattgctgatccattctgttttacaattttattagagcattgaaatagagacccttgtgcatacttgagtttattttgcttgaaaatatgatcattatattttatgactaaaactgaaaaaaagggcatgctgatttttaaagctgagcagtaaaccttatgttaattttgggtttgaaaactggagatgtaaagcagacattctgtaattcatatgtaaaattgaagtaacataatccatatcgtaagtttaaaatgcctcatttgtactttttgcttattccttttagccatcagatgatgacacagtcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataaaactttgaacaaatattaataacatgttctcttgatcttataaaagtggactatacaatttaaaatgtaactttcttttatataagggaaaagaaaaatgttctgaaaaatctcggaaaaatgaagaattaggagatgaaaaaaggtaagcacatatgaaaatgaaatgttatttataagcccttgagccattcattagatattcctacttgaaagagtacttgaaaaaaatataattttttgttcacttacctcttatgtttagatagttaatttataaatacttcacatctgtctgtattcctcaagtaaacacaaaattatagtaagcgtttgagtgtaggatgtgcactatttttacccctgaagtgtaatgatgacttctattattattattgaggaggactataccgtcatatacattgcttcatttgagctatttaacaaccataacaatagatggtattgacatcactttaccaattaagacactgaaaccaggagttttaaatggctggaactcagatgtattgtctcttgttctactatactttccatttggtcatgctgattatgacttttaagggtacttatgtccatattttattaaaataattgtgctttggatcttttttgaaccattcatcttataaaatgatgaaatatgacctaccacatttttttcagttactccttcaggttgctttatagatgcagaaaggaaagaagaaacatttggtgaatacctaccatataccaggattagtgctatgtgctttcccatgtttctcattttatcttcattaaaatcctgtagggtagatactgacctcattttttcaggtgaggaaggtgaagttcaaagactcttaagttttatgcctaaaaccacttagccagtgtccactagtacctagagtgtgaaagtagctctctttgatttttaaacttttctcttttctctacattatgcttcctccaaatgacttcacagttattagttaatcatctctgatgtcctgtaaggaggtacattgctttgtcttgaactgtttagatttcattcttttactttctcacctcatctaatgaggtcagttgcttaaacttgagaaacacctgtagcatgtacgatgtggtaaagtcacaaagattcatggtttgatactgtttttaaagtgaaatctaaagataaaatgactagagtttggataactattttaaaatttttttgttctcttttataaagatgacatattagtattttcacgcaaatttgccaatcttatttgaacctattttggattttctttatttagacatatacagatttttaaaatcaaaatcaataaactgataaaaacaggatggtgcaattaaatgacaaaattttacaatattttaaatttatgtattaagacaggccatatagaactctgcagtcctttttatactgaaggctggagaatatacatttttagattactattaaccattacacatttcagaaatctaaaaaatggtttatatactttgctattatttgttagtcattaattatattaatacagccagtatgctacatttcataatgagtagagaacacagaagttttccttatttcttattttagcattttaaaagaaggacctaggattttaactttcatatggtgttaaaaacaaaaatggtttctatttctggaagctggcataaaatgtagtctgccttactttttggataaccatgtttgtgtcacctttcagacttgagaaagaacagttactggcagaggaagaggatgatgatttgaaggaagtaactgatttgaggaaaatagctgctcagttattgcagcaagaacagaagaacaggtattcctttcagtaatgagatttgaattggcaaattttataatcattaaattgattatttaaagattatcaaagtatatgaagttttgagtaaacaatagtgccctcttaagatctatctcaagggactaactacagattgagtattcctcattcaaaaatctgaaatcggatcccaagcatttcaaataagggatactcaacctgtactaaaaggcaataggaaatacttaggacgggaatataaaattacatttacaactaacagaatgtactcatatatatagtcactatatttaatattgcctaggtatttcttttttattcctgtgtgtgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagacatgtccacttctaatgcaggaaaagttccatatgctgctgagggtcagctgttattgccatcttcatgtactgagaggactacatttatagttttgaaatgataaagatctgaatggtttttttttgctttgagaaaagagaataattttggtgcatttaacatggataagtaaaatattttatttcatttattcaaaataataaatgtttatggttaatatgaccatgttttgggaagtttcaaatttaaatatactggcatttgtttaaatgtacattgaaaaatacaactaaaacttatcaaatgacaaatatatggtttctaggggccactttttaggggcaatctatataatagctaataagctaaattgcctaagtgtcttttttgcacagttgctacatttatagatatacaaaatcatactagaaaatcactaacctttattcctttcatatcaaatgtatcttcatcagcagttcacatttttcttctgctgtaactttcggtctgctttttctgtgatgtttatcttttcaacttttcctgtgattcttttctaatgggccttttaaaaattggctacttatgaggctgtgtttgtttttccccctccaatataatttaagtgttgattgccctgtgatttaaaaggtttgatgaagcaagccaccacctgttctgtggagcttaaaaagtttctgtctcctctacctagcaggtgaaagaattgtatttatcattatgggacgataatattgtttttttaagaacccacagctagctgggtgccatggtttatgcctgtaatcccagtactttgggaggccgaggtgggtggatcgcttgagctcaggagtgcaagaccagcctgggcaacatggcgaaaccccgtctctaccaaaaatacaaaaaattagccgggcatggtggtgtgcacctgtggtcctagccacttgggaggctgaggtgggaagatcgcttgagcctgagaggcagaggttgcagtgagccaagatcatgccactgcactccagcctgggtgacagatctcaaaaaaaaaaaaaaaaaaccgacaggcctatccatttttctcgtggtattaggaatagcatttgagtgcataattatagatttttacattgtcatatacgatatttctgtatttccattttcttattagcatattagtttttcatctatccatgtgacttaaattattctttctagcctaggtacaacattgactgaatagttaatctttcattggttttatttttgtgatagttttgtaatcagtacaaaatagcatctagcactgtgccttatacatagtaaatacataatatttttgattgactgcttgaaaattaaatcaatacatttaaaactagtaggagaaattagttaaaaaattatatgttctccctaaaaaaaacttctgctgttcttcaagatgtatgcaaaagtaatttctttttctaattctcttctttatcatcctttttagatgttagtacatactaatataagaactttttagattaaatattaatatacagtgacattgttgtgataagtatgtctaattttttcagacattaaaatatttataatatgatcataaagtaaagagcacttttttttttgagacagagtcttgctctgttgcccagtctagagtgcagtggtacagtcttggctcactgcagcctctgcctcctgggttcaagtcattctcatccctcggcctcccaagtagctgggattaccagtgtgtgccaccacacccggctattttttttgtattttagtagagacggggtttcgccatgttggctaggctggtctgaaactcctggcctcaggggttccacccgcctcggccttccaaagtgctgggattacaggcgtgagccaccacgcccggccaaagagcacattttacttttaaaatttataacgtatggagaattttagatccctagccaattctgttaatgcctgaacttaaactggatctcagaatttttaaatgctaaatctaatattttttctattaaataatctttcttccttctacaatatgttactattgcttagatcttttagatttagggacttaaaatttttagtttactgtcacaatacttgaatttgaatgagaccaaaaatctaagcgtaatcctatatgagaatatatcctacagtggatttgatataatttataccttctctggttgtggattttccttttcatgctgtattattgtgtcttatattccaaatatattagtgaaggatctgaaatgctatttaaaattgtaggccaggagttgtaacatctctttttaggttttaaaataattattgtaaattttgtttgtttttagtcttgattaaaaataatttaactggattaagattaccctcgcctaccaggaaatatcatccaggactgctactttgactgtatattacttaactgttctttaacttgctactagtagaagacaaatgcaatgttagctctcagctaaatgaagccatgtatcttctcccaaactagaggtaattaaaaaacagcttacattgagttcagtgatgatttccttatggcagttttgccacttgcttagttcatatatatttttaattttttaatttatttttttttaatattttttgagacggagtctcactctgttgcccaggctggagtgcagtggtgcaatctcagctcaccacaacctccacctcccgggttcaagcaattctcctggctcagcctcccaagtagctgggactacaggcatgcgctagcatgcctggctaatttttgtatttttagtagagacagggtttcactgtgttggccaggctggtcttgaactgctgacctcgtgatctgcccgcctcagcctcccaaagtgctgggattacaggtgtgagccaccacgcctggcagttcatattattttttaaaatgtctttgattctttaagaaactttatgccagtacttggtacatgaaactatcctaggggagcagcaagaggatattgtacagaattaatactcaaaaagggtgagaaaagagatcagcaaataaaccatcaaattggtaactcataaggttttaaagtctgaagcctagttgtttagaagactgcctccactttgtctgattaagatgtgtaggttaagctactttatgtttacagtttattgttgaattttttttttttttttttgagacagtctcactctgtcgtccaggctggagtgcagtggcgtgatctcggttcactgcaagctccgcctcctgggttcacgccattctcctgcctcagcctcctgagtagctgggactacaggcgcctgccaccacgcccgactaattgtttgtatttttagtagagacggggtttcaccatgttagccaggatggtctcaatctcctgacgtcgtgatccgcctgccttggcctcccaaagtgctgggattacaggcgtgagccaccgcgccgggcctgaatttttttttttaattgataaacagtctttatcatcccctgtcaaaatattggattattatttctacttgcatctgagtgtattgaagtcactctgaatcaatgactttgactatatttaaatagctattcatcaagttctaattttaccttcactattattttgggaaataaaaacaagtcttgaaaaaaaatcattatcttaaaaataatgttgcatgatgagtaagttctagggatctgctgtacaacattgtgcctataattaacagtacagtattgtatacttaaaaatttgttaaaagagtagatctcttgttaaatgttcttaccaaaataaaataaaattgacaaaagggagcatgttttttagaccaagaaaaatcaaggaaggaactgagaataaaatgatactattagaatattcttaatattaacttgataataaaaaaggaaattctgttgaaaaacaaaaaagttgatatgtattattaattattgagccagttttacaaatttccatgagtcttactcatttatgttagtgttgaaaaggtggctactgctctttttcttatactgattttctttgggggcgtaataagtagatgtttagctggcttcttaaattttgtttagttactattctaaagaaaggattaaaatatatgtgtgattttgcagtaaatagcttcatttaactggttcccattgcatgtttgttcctgctaacttacgctgtagtattttctgttgtgtctttccttttagtaattattttatttgcttttaggtgtgtcttgagagtttttctttattgtggaaagatgtgcttctaattactatgtgatacagctaaataacaaaaagcaattatgaaaagttataattaaagtataattaaggatcatggaaagcaaaactaggtttaggaagtttataattttgttttagaattatagaaattatggacattacctgttttattatgatttttccctgatcatgtgaacatttcaatttgaggagcatcatgttaacctctagcttgttataactaattaggtggatctctcagtccttgaaatctatgtattcttttgtttctgctttctttacaaatgactaccctgtctctccaaaaacatcttctcccatcttttggtttggttgatttatgtgaaatatgaatacagacagaggcctttaagttgtaggagcatcattcagtgataaactcttccagaggaccagagcagcaggacatgaatcaaggtatctagagtttgtggaagccttcaagtattatggggccaggttgacatagctgaattgtatagtcttttacttaaaataagtactagtaactggattagggaagtatgttaataatctagatgtttaattagaatagatgtttgttttgacttttggtatcagagtaaatcataaaataatgaacatagcaaaattttacataggtgaattctcaagtacataaaatatattgtataggtaagtggatctcaacttgtttttctgtttcaatataactcatacacaaccgtaatcacaatgctaatgaatgtgtggtgagaaggagttagaatttactatagtgaaggccattgtagtttgagtcccctcccctgcaataattctgaaatttcccccagggtagtacttactgcggtctcttctttaaaaaaaaatcactcttttaaaatatatttttcctaatagttttagatatttcattaccttaatttttctgtatttaagaatttaaggcaattttaatgcatgcctatacaaagaagaagtgtccttaattctgaaattgtttggcccaaagctacactgattggtgtgtgatacttgtcctttgcatctcattatcactttttcctagtgaggccctactagatccacgctagtgaggaatccagcgtaatggactttggtttctttatgctaaccatatttctgtaattaccaacttatatttaattcattatgtattttattagtcaatatatagcttttatttaaaatccatttctgtattcttttggcagttgacgtctggagattttattttgaataaaaggccgagattttacttatattaaattttaaaagtgaaaattatatttatatatagtaacattaagaactcttaagtatagttccttatgttaaggacagtaattcattacttttgactttgagattaatacttagaattatgtaacattatgtagaaatagttctctcttataatggttcatcattttctttctttggttttctttgaatggttttatttagttattaaaagtttaagaaacttgtgtttttttaaagaattggactggagcgctgattttgcatttagaattaaaatttttcatttggcaaaataactatgtattacataaacatacctcatatcatttgctgtgctgggaaaaataaatcagtcacgatggtacctctgtatctctttatcttctatctcagccaaaagttagatatgcaaagggcaataatagcatgggtagaagatatccaaactttgagaaagggtttataaacgaagatgcatggaaaagttgccgagcttcattttgttataaaatagtacacttatgggcatctgatctaaataatatttaaatattattttctagcaaagatcttcaaggaccagatgcagtttattttagagattttttttatatcatgtgatgtaatattcttaatagatttgggaattaatgtgttgatttacttctaggattcttaatcattcaacttctgtgatgagaaacaagccaaaacaaactgtggaatgtgaaaagaggtataaaaatatcttagtttttacatttaatattttataatgagtattgatcctttgacagtgatgtttttgtatataggctttaattaaataagtgatacagatttaatataactagataatttaaataggaaatgttttagaacatgagttaaatttacttttgatgtaagcaaaataaaaaatgctgatcttttttgctcatagatgcatttttgtcttgatagaatcatttatttgttcattcagtgaacatttattatattgctattcctgccaggaataatgtgtttctttatcattgattgtgtttattctctatgatactgtttatgttttcatttcttttcaattgggtggtactaaattcttctatgtgaatacatgatataaatccacatatatgaattcctgagaactagaagaccttgaaagtttctatttattctttttgatggtttgaatttagattagactcaactcctgagtcaatcctctgagaatgttcaggcccagtctttttctgcttggcttattccagcagtcccaagacatagctcctttttttcaggtttgcctagctttaagtctgtcttctgcacaatggaagagtgataattctgaaacaaatcttacttgtgactcccatttattatcttctaatgactctttacaacttttagaataaaccttaaaatatttaacttaacccataagattgaggtgggtttctgcttaccctgagagcttcatcttgtacattcccccactggcaccatttgcatttaggaacagaacttctttcttcattctcttggggaagttatttagcttactctgagccacatttaccccttctataaaacacaaataataacagtgtctacctcatggttactgtaaggatgaaatgggttaatgtagtaaattgcttatgacggtgattagcacacagaaagtgtcacatatgttattagttgttaaactaagttattactattgtgaactttcttatttttcctttcttttgtatctcagcccttcctttttcaattctaacctccttttttgttcaaaagggaaatagctttgtgggtattctttttctggtattaagaagtattatatgaccttaacttttttttctttttttaaattatactttaagttctgagatacatgtgtagaatcggcaggtttgttactaggtatacatgtgctctgatggtttgctgcacgtatcaaaacacattaaattatgggaatatattttaaattctgtgacttttttcagcagtacgtgggtgagcacaccccaccccttccccacctttagaaaaatctcacatactttctgttaacaaaaatgagatcatactgagtatactatttagtaatatgcagttttcacttaatattatagtgatggttttatatacctactaaatctaaatatacattttgatgaactttatatatcctgtacacttgtattttccttccttccttcctctctttctctttctctctctctctctcttttttttttttttttttttttttgacagagtcttgctctgtcgcccaggctggagtgcagtggcgcggagatgagatttcaccatgttggccaggctggtctcgaactcctgacttcaagtgattcacctgcctcagcctcccaaaatgctgggattacaggtgtgagccaccacacacctggcccacttgtattattttcttaacttaaatgcttaaagatatgttattgatggattaaaacatgagtgtacatttaaagcttttgatatgttgtctccagaagcttttatgtttgcattcccacaagtaacacatggatagctttacttccatacttgttaacactatacattatcaatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctgctttttattgaatctgacaatctacgttctaattgcaatgttaaaaatcatttatgtttttgtaattaatgatattttgaggtttgctgtatgttttctttctgttctatcctttttattcatttttcctccttctctgttgtcttttgaattatatttaaaaatttttgtttatttcctttgtgggcttatttgctgtaactttttgttatgttaatggtttttttaggggttagagtatgatatttagcttatcacagtctatcttcaagggctattatgccatttcgtgtgtcatgtgagaaccttagaacagtatacttattttttttcctttttagccttggtgtgttgtcatacattttactttttatgtatctgttatgtgtaccataacaagttgttatttatgctttaaacagttatttgttcttaagaacatttagataatcagaataatgtcttttatgtgttcaatcccttagttactatctccagtgccctttattttttgtgtagattcatatttacatgtgcatcactttctttctgcctaaaagagagattttaacataattttactactggtctgctgattgaatgcttttagcttttctatgtctgaaaaagtctttttttaaattttttttttttaaacaggatcttgctctgtcaccgaggctggagtgcagtggcgccatcacagctcactgcagctttgacctcctgcactccagtgatcctcccacctctcagcctcccaagtaactgggaccacaggcatgtgtcatcccacccagccaacttaaacatttttttttttttttttttgtagagacagggtctcactatgttgcccaggctggttttgaactctcggtctcaaggaatcctccttccttggcctcccaacgtgttgggattacaggcatgagctaccatgcctagctcaccttcgtttttgaaagatattttggctcatacacaattctagtttgacattttagttttcttcgagtaccttgaagaggtttctccaccatcctctggattgtactgttttctatgagaatattcttatctttgttttactttgcctaatgtgtccttttttcctctgggtgtctgtaacattttttatcactcgttttaagtaatttgatggtgatatatcttggtgtagttttcttcatgttacttttgtttggagttcattgagcttcttgaatttgtgggtttattttcatgaaatttgaaattttggggcccttatttcttcagatatgttttctatcatttgacctcttctattatggaactccaattaggccacttgaagtttgccatggaacattgatgttctattcattctttaatatttttctgtctgtgttgggttttggcaagtccttctgctttgtctttgtgtttgctagtcatttcttgtgaaatgtctaatctgcagttaattccatccagtttgttttaatttcagatgttgcactttttatttctagaagtttgattatgtctgtacttaacatgttcagtcttttcctttagcttcttgaacattgcttggttgaatttttgattaaatgacagacattgtgtactttacattcttgagtgtggatattgtattattatacatacttttgacttttgttctgggatatggttaaattacttggaaataatttgatattttgggacttggttttataatttatttatgtgggaccagtgcagcatttagtctaggaataaatttgtccccttaatgaggcaagacatttctctactggatgtcctgtgaattatgaggttttccagtttagctggtgggaactggtactactcctggtcctctgagaatctgggaattattccctctaagctttgagggtgattttatccttttgcctagggtattttcctcacatacatgttcaatgatcagtacgctcagatgaaaatttgagggatgcctctgtagatctctttcctttctctgtgcattgcccttttgtttgttactgtgtgctatgaactcactctgcccttttctccctggctccagctctgtctcctgaattctgggcctgctagactctgccttagtttttttctcctgggatgtggactggaaactctttccatgcagcaacttggctcagttatgggatttacctccttactcatctctaaaggataatgtcattttttgcctaatattcaatgtcatggaaggcataattttaaatattttgcccattcttttagttttttcagtcaggatataaatctggtcactgttagcctatcttggccactagcaaagtctagtttttacattttatgtgttcaaatttgttagtatttaattttgattgtttgtcccataggctctctctattccaatatttaaaaaattactgcctgtatttttctgatactttgtgatttcttctttatatttaaatcttttaatttttcattttgatatttggtatgaggtaaggaatctagttttcttcctcccccacctttttctcactgtgtctcctcccccttttttattctttctttcagtgtatattttacacgtgatcaatcaggtgtctctctactacttgttatataagccattactttcacaatgatcttaaatgtcatttttttcagaagttattatactcgtggtcctgtactcctcttccattgaaaaatctgtagattctggagctagtagaaaggagggttgaaaagtcctctttattatataacttttctcttcgtgatcatccattcttccaaattaactttggaactcctttgtcaaatgtttaaaacaaaccaaaaaatacttcttgagttaaaaaaattattattacagttcatttcagttattaattaagttgaaagagaagttatacctgtaatacttatctatccaagaaccttttggttattcaagtctcttactagacatttgtagttttttcatgtaggtcttgtagaagtatagttaagtttcttcctaggtattttatacttttctttccttctatgaatagcatttttttctaatatatcttttaactcattatagttgatatgtaggaaagctattaacttttgtatgtttttctttaactggtaaccttacctcttataataatagattttttgtctttttctcttggataatcatgtgttctataaattttaaaaattggatctttatatccaatttttattttctttttgttattgcactatacagaaattccacaatagtgttaagttatagcagcttcagtggacattttgtttatatattttttccacaggaactccttgttcaaaattgccatctaacaacagcatgcatagtctgccttatctcaacaacaaaaaattagatgaaaataatttccttcatagcccctgttttgttagaatgaacaggttgcatctcataatcagtaattcagtaggcaaaaataactactcgcttgagctctttggcatttagacaaaggaaattattagttttttttagtctttgttaattattttaatataataaatatcctgtctgtcctttgacaatatatctttagatatttcacttattttagcttctgggaattccttagaatagacctatgcatagggcctacatagaataaacccattttgatatttcctgtagagcaacaggttttagaaacttaaatatatttctgtcaactttaagttttatgttgttaggccaaagtgtagacatgggtaaattctttacaatgtttttaaaaagataacatctaaggttcataatatatatttaaggatttattctaaatattttaacgtattaaggcatcttcaattttttagtgtctcagcagatgaagttaattcaccattatcacccctcacctggcaggtaagaagaaattaaattacaattatatctatcattttgttctcttttatttagttaaaataaattgtctcattatagcccttagaaaatcagaaggatcaaatagatgaacaaccgtggccagaatctcaccctataatctggcagagtgaagaaaggaggcggagcaaacagattagaaaagaatatttcaaggtactctatattaagtttttaaatttactttgtaattattagtttttattttgtcagttttgttttgagttaataaggtagactgtaactctctagttaaatgtagtaaatgtgttattttgatttctcacatatatggggtaatacaatctaattatatccataaggtttcagtaattgagaataattgagtagataaatataaattatgatttaccaaatactttgcaagatagacgaatgtttgctgcactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttcttgttaccttagtagattgcttgagtgtcttttatcttagctaaaagaaaagctcagatcatccaaattatcccacatttctagttagcagggttttaatgaaattttactgtgtacacatttgtaaatattgtattattgtctatttgtgattggggtctgctgtatttgtagaagccaatcattagaattcagaataatattcaatactagccagaattcattactggatttgactcaaatgaatagtacaaacaagcttctgctccatgaatagcaaattttgttgtctttgtacacgttttatgtttcccaaagcctaattattattagatgataatagtaatttcatctgaaacatagtactagtctacattgtaggttcaagtttatatcactaataaataggattatattctctgtttttctctggtagaaataggtctgtatgcacatttgtttgtttctatatatgggtgtgtaacatacatttggaaatagtatcatgactaaaacaaaactgttatatgtcttagtggatctgtggtaaatttaagccttcaacaaataaatactgagtccttttaatgagtcttacatttcctggtcaatataagagataacaaagaaacagaagacatgaggaaaaagggaaggacattctaagtagaaccctggtcaataatagtgaaagtttatttatcctaaccctttatacatctgtaattgtgtttacattccagcattattttaaagtttccctttttagttcattggaccttgaacaaagcactgaataaaatttgcttgtagataaaacttagtgaatgactgatggtatgggggaaattttagtagtatttcatataataaaagaaatttaatatttatttgctctcctttattgtagtataacaatacaaattcttagtatactaccaatatcgtagtataacaaaaccagttctcctttatcatagtaacaataccaattctgactatttgtcaaaaaacttacatagcacttattaagtgccaggcactgtcctaagacttcacaaagatcaactcatttaatcctcataacaaccttatgaggtaagtacaattatgactatttctgttttacagatgatgaaattaaggcacagagatgcaaagtagtattcttcagttcacttagtaataagtggcagagttgagatttgaacccaaagcctatgctaggctgcctctttatctactgtgtatagcttaatatcatatcagcaaacactttcaaacaaacacagttttactggtttttaatttttttttttaagagacagagtctctctctattgcccagactgcagtgcaatagcgtgatcatagcacacagcagcctcaaatgcctgggctcaggccatcctctgggctcacgtgatcctcttgcttcagcctccccagtagctagaactacaggtatgtcccccagtgccctacaaattttaaaattttttgtagaggtgagatcttattatgttgcccaggctggtctcaaattcctggcttcaagagatcctcccatctaggcccccccaaagtgctgagattactgacatttttggcccacttttagtgtttaaaaaacgttttacagtaacttgagtggacttctcaagatgtcttaatagaggccacattttaaaaatgtgcattttaaaaactgagcattttaaaaacataattctttggtttcatagcatcatttattggtattttattttttataaaataaacatcttctataatattagttatgttataaagttattaaaagagatcaaatgatataatatttgaagtgctcattacataatcatcattcaacaaatgttaatttttttccttaataaattaggtgcaaagataagcttcagtcactgggaaatgttttaaggagatgtgtagttctcctaaattgtcagaagatgtcagtattaggacatagtaaaatgagtatgtcactagttttttttcctaagatgtcaagaaaatataaaactgacatacagtttcctaaattaaatcaacactattattcagaattgtcactattttcatgactaaaacatcagcagcttctaagaggaaatttctcttaatcacctatctcccgataattgaaagtgctattggtaggttgtattattaaagctaatctggatttatagttcattaaacagtaaaatacactacacttgaggtttatatcagattatcactgagtttgttcaatggtggctcttttaggttttgctatgttacgaaatgtacagaacttttgtgcaactttatcttaatacgtataaatgactgaggcacaggatttctttgtttctgtcccatggtaaattatttgtcatggttattcagtgtatttattgaatgtgtgtgtgtgtgtgtgtgtgtgtgtgtgtgtgtgtgtgtgtgtgtgtgtgtatgtatgtaagaaatccaactgtatttcttcttagttttgaaggctaattttggatagtatttttttcaggtaagtccctgaaactaggtaaaactgtttcaacatattggctagattatgtgagcaagaacacaaattgggtcaggttaagttagtaagtaaatcatggtaggaaagttacattgactcttttagattcccaggccgctatcgtatagattattattctagtatataaaatttagtgttcttatagccaaaataaaatcactgtatttcagggaacttcatgatgccaggaagtattttattaaacatctttttttattttaaatttttaatttttggcgttcatattaggtatatatatttatgggatacatgagatattttgaaaggcatacaatgttcaataatcacattatggggaatggggtatctattccttcaaacatttatcatttgtgttatgatcaaattatactcttagttattttgagatgtacaattaaattattattgactatagtcaccccattgcgctatcaaatactaggtcttatttattctattttttatgcccattatccatcttcacctaccctctactcccccactacccttctctagcctctggtaaccatccttctactctctatctttatgagttcaattgtttttacatcctacaaataagtgagaacatgtggtgtttgtctttctgtgcctggcttatttcacttaccataatgacctgcatttcaatccatgttgcaaatgacagactctccttctttatggctgaatagtactccattgtgtatgtgtaccacattttctttatctgttcttctattgatggacacttaggttgcttccaaatcttggctattgtgaatagttttgcaataaatatggaagtgcagatatctctttgatatactgatttcctttctttgggttatatacccagcagtaggattgctggattgtatggtagctgtatttttagttttttgaggagcctccaaactgttctccatattgttcgtactaatttacattcccaccaacagtgtacgagggttcccttttctccacatcctcaccagtatgttattgcctgtcttttggatataagccactttaactggggtaagatgatacatcattgtagttttgatttgcatttctctgatgatcaatgatgttgagcaccttttcgtatgccagtttgccatctgtatgtcttcttttcagaaatgtctattcacatcttttacccatgttttaatctaactattagatactttcctaaagagtcgcttgagctccttaaattctggttattaattccttgtcatatgggtagtttgcagatatttcctcctattccgtgggttgtctcttcactttcttgtttcctttgctgtgcagaagctttttaacttgatgtgatcccatttctccatgtttgctttggttgcctgcgcttatggggtagctcaggaaatttttgcccagacctgtgtcctggagattttcccccatgttttcttatagcagttttatagattgaagtcttagatttaagtccttaatccattttgatttgatttttgtgtacaacaagagataggggcctagtttcattcttctgcatacggatatccagttttcccagcctcatttactgaagagactgtcttttcccccgtgtatgttcttggcagctttgttgaaattgagttcactgtaggtgtgtgaagttgtttctgggttctctgttctgttccattggtctgtgtgtctgtttttatgcaagtaccatgatgttttggttaccataggtctgtagtataatttgaagtcatgtaatgtgattcctccagttttgttccttattcccaggatagctttggccattcttggtcttttgtggtttcatctaaatcttaggcttgatttttctatttctgtgatgaatgccattggtattttgatagggattgcattgaatctatagattgctctgagtagtatggacattttaacaatattgtttcttccaatccatgaatgtggaatatctttccatatttgtgtgtcctcttcaatttcttccagcagtattttatagttttcattgtagagatcttttacttctttggttaatttctaggtgtttaattttgtttgtgagtattgtaaatgggattatttttaaaatttcttttttagattgttcactgttggcatatagaaatcctactgacttttgtatgttgattttgtatcctgcaactttacagaatttatcagttctatttttttttttttggtggagtctaggtttttccaaatacaagattatatcatctgcagacaaggataatttgacttcttcttttccaatttggatgccctttatttctttctcttgtctgattgctctaggtgggactcctagtattgtgttgaataacagtggtgacaatgtgcatccctgtcatcttttagatcttaggggaaaggctatgagttttggcttttattatgttgagatatatttcttctataccccagtttttgagagtgtattagtctatttttatgctgctgataaagacatacctgagactggtcaatttacaaaagaaagaggtttattggactgacagttccacatggctgaggaggcctcacaatcatggtggaaggtgaaaggcacgtcttacatggtggcagacaagagaagagagcttgtgcagggaaactcctgtttttcaaatcatcaggtctcatgagacttattcactatcatgagaacaacacgggaaaaacctgcccccatgatttagttacctcccactggtatctcccatgacacttgtgaatcgtgtgagttacaattcaagatgaggttttggtggggacacaagcaaaccatatcagagggtttttatcatgaaggaatgttggattttagcaaatgcttgtccggcatcaattggaatggtcatatgatttttgtcctttattctgttgttatgatgtatcacaacaattgatttgcatatgttgaaccatgcttgcatccctggaataaatcccacttggtcatgatgaatgaccttttaaatatattgttgaattcggtttgctagtattctattgaagatttttgcatccatatttatccgagattttggcctgtagttttctattttggatgtgtctttgtctggttttagtattaggctaatactggccttgtagaatcagtttgccagtattccctcctcttcaattttttgaatactttgagtaggattggtattaggttttctttaagtttttggtagaattcagcagtgaagccctcaggtcccaggcatttctttcctgggagactatttattacagatttgatctcattacttgttattggcctgttcacattttggatttcttcatgatccaattttggtaggttttatgtgtctaggaatttgtccatctcctctagagtttccaatttatcggcacatagttgttcatagtagctagtagtggcccttcgaatttctgtggtatcagttgtaatgtctcctttttcatctctgattttatttgggtcttctcccctttttatcttaatctgactaaaggtttgtcaattttgtttatcttctcagtaaaccatatttttgtttcattgatcttttttatttttcttcatttcaaatttatttatttctgctctgatctttattatttcttttgtttttgtttgtttgtttgtttgtttaaaccagagtctcactctttctcccaggctgaggtgcagtggtgtcatggctcactgcagccttgacctcccagggtcaagccatcctttcacctttcagccttccaagtagctgggactacaggcaccaccacacccagctaatttttgtattttttgtagagatggggttttgccatgttgcccaggctggtcttgagctccttggctcaagcgatctgcccacctcacgctcccaaagtgttgggattacaggtgtgagccatgacacctgggctgtttcttttcttatactaactttggatttggtttgctcttccttttctggttctttaagatgaatcattatgttatttgtttgaggtttttcttctcttttgatgtaagcacttatagctggaaattttcctgttaatactgtttttgctgtatcccataggttttgctatgttgtatttgtattatcatttgtttcaagaaatttttcgatttccttcttaatttcttcattgacccactggtcattcaggagcatattgtttaatttccatttgtttgtatagttttaaaaattcttcttcttattgatttctggttttatttcattgtggtcagagaagttgcttcatgttatctcagcaacttctttgttgtttgactgttttaagacttattttgtgacctaacatatggtctatccttgagaatgatccatgtgctgaggagaagaacatatattctgtagccactggatgaaatgttcagtaaatatctgttgggtccatttggtctatagtgcagattaagtccaattgttctttgatgattttctgtctgggagatctgtccagtgctgaaagtggggtgttgaagtctccagctattactgtattgagatctatctctcttgagctccaataatatttgctttatatatctgagtgccccagtattgggtgcatatatacttacaaatcactatatcctctgactaagtttacccctttttcattatataatgaccttctttgtctcttgttcatttttatcttgaaatccattttgtctgatataagtatagctacacctgctcttttttggtttccattggcatggaatatctttcttcatccctttattctcagtctatgtgtatcttcgtaagtgaactgtgtttctttttttttcttttttctttttctttctttcttttttttttttttggtggagtcttcctctgtcacccaggctggagtgaaatggcatgatctcggctcactgcagcctctgtctcttgggttcaagcaattttcctgcctcagcctcctgagtagctgggactacaggcatgtaccaccatgcccagctaattttttattttttgtatttttagtagagatggggtttcaccatgttggccaggctggtcttgaactcctgacctcaagtgatccacccccctcggcctcaccccaacattgctaagctaaagggaaaggtcaagctgggaactgcttaggggaaacctgcctccaattctattcaaagtcaccactctgctcactgagataaatgcatatctgattgcctcctttggagaggctaatcagaaacttaagagaatgcagccatttgtctcttacctacctatgacctggaagtcccctggccgcttccagttttcctgcctttctggactgaaatattgtttgtcttacatatgttgattgatgtcttgtgtctccctaaaatgtttaaaaccaaagctgtgctctgaccaccttgggcacaggtcatcaggactgcctgaggctgtgacacaggcactatcctcaaccttggcaaaataagctttctttttttttttttgagacagagtcttgctctgtcacccagtggcgtgatctcggctcactgcaagctccatccccaaggttcacgccattctcccgcctcagcctccagagtagctgggactacaggcacccgccactatgcctggctaattttttttttttgtatttttagtagagacggggtttcaccgtgttagccaggatggtctcgatctcctgacctcgtgatccacccctctcggcctcccaaagtgctggaattacaggcatgagctaccacgcctggcctcaagtgtgtttcttgtaggtagcaggtcattgtgtcttattttttcatctattcagccattctatgtctttttattttaatagtttagttcatttacatttagtgttattattgatgttttattctactgcggccaagatggcactcacaccacaatacaaagtccttgccactcttctttcccctttccacaggtagaggaacctctctcagtggccaccaccaccactggcccatgggaggttctgctagcccgctgctcatgttctgttaaagcccaagggctcttcaatcagcttgtggtgaatgctgccagtcctgggactcaccctgaattctggcttggggcaggtccagaaatgctgcccaagagccgaggcctagattcctgaactccaagagactgcttgttgcttacctcactgtgtctgagtgggttcctaaggtgccaaattcccctttgtttttccctctgcttttctcaaacaggagactctccatgtagccacgacatctggttttgtgctaagtcttaccggacgccagcacatctcagtctctcccaaggtccacagcatactacctgggtatttctgctggttattcagggcccaagggctctttcatcagctggtgatgactcctggcaggactgggtccttcccttcaaggcagtgggttccctttttgcccaggggtatatgtctagtaatgtcatccaggagctggggcctggaatgggggtctcacaactctggccagtgccccatcctactgtggctgagctggtatccaagaggtaagacaaagtcctcctcagtcttccctgtcctgtcctcaagtgaaaggaaggggtctctttctcattgctgcgagctgcactgtctggggttgggggaggagtggtgcaagcactcccttagccacccctgctggtgtctccctaagtcacatgccaccctagtacactggttctaagcttagcacagcactaggagttgcctagaaattgcaatccttgtgccctagactgcctttcaagtttacctagaaccccagagtactttggcctgcgattggtgaggttactgagaaacttaagttcaagctgctggcatgagcgattcccatctggttagggctgatccaaatgctcccgccatgcctgggtgcttgttgagcacagcacaactttgttcccctctgtggcagggcagcactaagttcaatgtaaagccccccagtccctgtgctctccctcccccaagtatacaggctttctctccctgcactgctggctactgtgggtagctggctaatttttgtatttttagtagagaccgtgtttcaccatattgtctaggctggtctcaaactcctgacctcgtgatctgcctgcccaggcctcccaaagtgttgagattacaggcatgagccaccgtgcccggccacaggtgaatttctaaatgcatttaataattgatttctagacaaaacagttaaaaagtattagagtatctgtagccagttagttttaaatattatttgatttatttaagtggcatatatgtcttcaaatgtatctcattactattatgataaaacataataactcataaaatacatattgatttcataaatatagtacactatttttatttaaaggttaaccccctggaaaatattttgacacattttctatgatcattgttcgttttatatgggagtaaagaagccactgggattgtaaaataacctgatttattctgagtcagagtttatgcacaagttattgtctctcttttgaaattattacaagcttctgaggctagtccgaattcaatggtgtttacaacgaattgctcacaattacacatttgtttattttccactcctgctgcttcacttgactagcctcaaaaaatatgtatatgtatatgtatatgtacataaaagcttctgagatggactgacctttctgtttttctggtttttaaactaggcctttattgtaacatttgaatttagatgtaataaaacttcagtaattcagaattcagattaatactagttggggatagccgagttgaattagtaaaaacttggaattagagagtattttcaaatctatgtatatattaggtttggagtttcaagacatttaaatatgtgcagtaatgcaaacttagcatctttctaagttttcatgtataatgagtattttaaattagaattatagttgagtaacagtaatacatttcccattttctaagttcttaagtatatcatcttgtatttctttgcatttcagttatcctcttattcttctatgtctttcctgcctctttacctttcaccttataaatatgctcaaacctctgttatagggaagaaaaagtagtatcttttccctactcgttgcaagaatgatagctgacaccccataacaaaagatggattaacaagagaaaagcataaaaatttactcaagtttttatgtgacacaggatccttcagaaatgaagacccaaagacccagggaaaaccgtatgttcatgctaagtctgatgaaagaaatgaatagttgtggagacacgtgattgaacaaaaaagggtatgatctaatggtaacaaactgggcctgtttgttgagaatcttttctgtgtctctctatgacattccttctccttcggtatgctgcaggaaacctgtcacatgcatcttaaagggagaagggaggaggtcagagagtgacctttctagattgtatggcttgctttgtgagacggggaattctagtttctattacctgccttagggagaggaaggggggcgaagaaaggggggcctggagaaggtcagagagtgaccttgaaggtgccatatcttggggtagtattttctgagccctgacactaccattatccctgactgcccttttagctgttgccttatctctttgctctcttttagggctaaactttcttttttttttctcttgagacggagcctcgctgtgtcacccaggctggggtgcaatggcgtgatctcagctcactgcaacctctgcctgccgggttcaagtgattctcctgcctcagcctcccgagtagctgggattataggcaccctccaccacacccggctgatttttgtatttttagtagagaaggggtttcactttgttggctaggctggtcttgaactcctgaccatggccagggccaaactttctatttctagttctccagtttctgatcattccttaacccactgcaatctggcgttcgcttccatttctccattgaaatagcccctcgctagattttaacatgcacctactaatggcaaaatccagtgtagcatttgacaatgatgaccacatcttccttcttgatactcctgtcttggtttctatctcatttttcttccctgttatcattttgatgtccttctctaacttttcttctgcttgctcttagggtctgatcctcattttattactctaaaaagctctctctggagtgttaatgactctagatgtttcttatattctgctgtgtctaaatttacatcctataactttttttctgttccctaaatctgtgtttctaattgtttggatgccctcattcccatcacctaattggttatcagccctaatatatgcatcgtttctgcaattcatgtctatctctattgcccttgccctttttggaaccctcatactttcttgcccaggcaattgtgataactgattaatggtcctcctttctcagccgttggataattctctggctttaaatttctttattctagtgttcagtagcaccataggttgactatagttaataataatttattatatattttaaaatagctagaagaaaagattgataatgttcccagcacaaagaaatgataaatgtctttgaggtgattaccctgatttgatgattacacattgtatgcatgtatcacaatatcacaagtacctgataaatatgtacaattatgtatcaataaaaaataattatcagacaatgtgagaaaatgcccttaaataaaactgtaaatctgtaaattttctcttaaatctgtaaaactgtaaatcatccaaaaaacttcttactggcttcccattaccaataagataaagtttggatttgttaaaatcttcgtggaccattccttctttccttttctatatttcattacctgccaaaattcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtaggggtcttggaaccaatcccttgcagatatcaagagatgattttatggcacagtgcctgggcttatagaatcaaaccacttgtgttccagtccttacttggatacctattaactatgtgactttgtcaagtcatgtaaccttaattaagtttgttttttaaaactttataaatgagtgtaacagtacaggcatacttaagagatattgtgggtttgattccagacaatgccattaaagcaaatatctattcaataaagcaagtcacatgaatatatatcaataaagcaagtcacatgaatattttttggtttcccagtgcataaaagttatgtttacattgttctataatctaagtgtgtaatagtattatgtatgaaaaaatgatataccttaattaaaaatactttattgctaaaaattactcacaattatctgagccttcagtgagtcataatctttttactggtggggggtcttgtgtagatgttgatggtggttgctgaaaattgggtgaatatggcaatttctagtttgccacatcaatggactttcctttcacaacagatttctctgtagcatgcgatgctgttagatagcattttacgtacggtagaacttctttcagaattggagtcaatcctctaaaaccctgccactgctttatcaaataagggtatgtcacattgtaaatcatttgttgtcatttcaacagtgttcacagcttcttcaccaggagtaaattctaccttaaaaatccctaccttttttgcacatccattaaaagcaactccttatttgttaaagttttatcatgagattacagtaattgagtcacaactttaagctctacttctaggccaggcgtggcagctcatgcctgtaatcctagcactttgggaggctgaggtaggtggatcccttgagctcaggagtttgagaccagcttgggccaatggcaaaaccccgtctctacaaaaaatacaaaaaaattagctggtcacggtggcacatgcctgtagtcccctctacttggtcgggggtggctgaggccagaggattcttagagcccaggaggtcaaggctgcagtgagccaagatcacgacactgcactccagccaggtgacaaagtgagaccctgtctcaaaaaaaaaaaaaaaaaagaaagaaaagaaaaggaaataaaaactctacttttagttctcctgctgtttccaccacatctacagttatttcctccactgatgtcttgagcccttcaaaatcgtccatgacgatcagaatgaatttcttccaaactctcgttaatgttgacattttgacctcctctcatgaattataaatgttcttaatggcatctagaatgatgaatcatttgcagaggttttcaatttgctttgcccaggcccatcagaagaatcactatctatggccccaatagctttatgatatgttattacttagtaagacttgaaagttgatattactccttgatccatgcactgcagaatggatgttgtgcatgaaaacattgatgtctttgaacgtcttcatcagaactcttggttgactagactcattgtaaatgagcagtaatattatgaaaggaatctttttttctgagctcgatagtgggcttaacatattcagtaaagcatgctgtaaacagatgtgctgtcatccaggctttgcaggtctatttataaagcacaggcagaatagatttagcataattcttaagggacctaggagttttggaatcgttaaataaacattggcttcaatttagagtcagcagctgcattagcccctaacaagagtcagcctgttctttgaagctttgaagcaggcattgacttctctctatctacagcagtccaatagaaggctattttgtctacatagaaaatttgttgtttagcgtagtcaccttcatcaattgtcttagctagctagatcttctctataacttgcttcagcttctacatcagcacttgctacttcgccttgcacttttgttacgcagtcagcttctttccttcaatcttatgaaccaaccaacctctacagcttccagcttttcttctgcagcttcctcaccttgacttcataggattgaagagagggccttgctctggactaggctttgtcttaagggaatgttgtggttggtttgctattctatccagaccactcaaactttgtccatatcagcaataaggctgtttcactttcttatttttggtgtgttcactggaatgagtagcacttttacttttcttcaacacttattttgcattcacagcttggttaattggagcaagaggcctagcttcaccctatctctgctttctacatgtcttcctcactaagcttaatcatttcaagctttttatttaaagggaaagacatactatttcttttcacttgaacacttaaagaggccattgtgggattattagttggcctaattacaatattattgtgtgtcagggaataggagatagggaacaactggttagtggagcagtcagaacacatgcaacattgatcgattaagttcgctttcttatatgggcgtcgtttgagtcacccctcaaaaattacaatagtaacatcaaagatcaatatcacagatcaccataacagacatgataataatgaaaaagtttgaaatattgtgagaattctcaaaatttgacggacatgaagtgagtacgtgctattggaaaaatgacaccaatagacttgcttgatacagggttgccacaaactttttctgcacattttgaaactttgtatttgcacatttaaaaaattgtgtatcccgataaataaaatcactggaacaaaaaaactgatactctgattaaactgaattttatagcttgcaggacaccttgggccagcttggttttactctagctttcactgtcattccaccctgcttcttccttcaccaacattcaaattcttttccttatctgccagccaggcagatcggagaggcaagagcggtcttcattttcagtagctcttgattctttgatgtgagaggagcagcacagtcgtttaaacttgatccaacctctttgcatcttgcaaagtcaatcagccaaaagaagtaaaatatgaaggcaatgcttgtgcaatgtacagttcgttttcatgatgtatacctcattatgatttgtctgcttgcttctcctgtttggtcatttctttggaaggcagtggatttttttcttgtgttttttgtcttcttcaattttgacttaccaaatttctcaatcccagccatatcgggtttgttggatgtggttgccaaggaagtggagtaaggcgtttgagcaagcagaatctggtctgctcataactattaaattatttaataataaaagtacttagaattacacttgccacagagtaaccacttagtaaatattagcatattcactcaagtatcactgtttcattgacatagattaaaaccaaaaataagtgacttcagtgattgtcttgcctgataaataggattttttcacacgtgccaatttcattcagtggctctctggcacactgggttgaaggcatattgagattctgtgtgagatcacctggaaagaacatgctgctagattagtgatagttgccataggagagacagtggaggaagaatacgttttgtatttattatccctaatatagctcacttcccagtttttggctgagatatcaggttggttatctatttttccaagggttgtggttgagatatcaggttggttatctatttttccaagggttatggaagataatgctgcgtatgtaaaggggaccattaaatagaccaatggaacagaacagagccctcagaaataataccacacatcgacaaccatctgatctttgacaaacctgacaaaaacaagaaatggggaaaggattccctatttaataaatggtgctgggaaaactagctagccatatgtagaaagctgaaactggatctcttccttacaccttatacaaaaattaattcaagatggactaaagacttaaatgttagacctaaaactgtaaaaaccctagaagaaaacctaggcagtacctttcaggacataggcatgggcaaggacttcatgactaaaacaccaaaagcaatggcaacgaaagccaaaattgacaaatgggatctaattaaagagcttctgcacagccaaaaaaactaccgtcagagtgaacaggctacctacagaatgggagaaaatttttacaatctacccacctgacagagggctaatatccagaatctacaaagaactcagacaaatttacaagcaaaaatcaaacaaccccatcaaatagtgggcaaagcagatgaacagacacttctcaaaacagacacatgaaaaaatgctcatcatcactagccatcagagaaatgcaaatcaaagccacaatgagataccatctcacaccagttagaatggcgatcattaaaaagtcaggaaacaacaggtgctggagaggatgtggagaaataggaacacttttacactgttggtgggactgtaaactagttcaaccgttgtggaagacagtgtggcgattcctcgaggttctagaactagaaataccatttgacccagccatcccattactgggtatatacccaaaggattataaatcatgctgctataaagacacatgtacacatatgtttattgcagcactattcacaatagcaaagacttggaaccaacccaaatgcccaacaatgatagactggattaagaaaatgtggcacatatattccatggaatactctgcagccataaaaaaggatgagttcatgtcctttgtagggacatggatgaagctggaaaccatcattctgagcaaactgtcgcaaggacagaaaaccaaacaccgcatgttctcagtcgtaggtgggaattgaacaatgagaacacttggacacagggtggggaacatcacacactagggcctgtcatggtgtggagggggggggagggattgcattaggagatatacctaatgtaaatgacgagttaatgggtgcagcacaccaacatggcacatgtatacatatgtaacctgcacgttgtacacaagtaccctagaacttaaaatataataaaaaaaattgaccacaaatataactatatacaaatgtaaaaataataataatttaaaaaaatttacaaaaaagaaccttgaatgccaggcatagaaatttggacataatctgaaagttagtaggtgttacaacagggcagtcatgagttgtaaacggaaggttaatctgccactgatttgcaggatcatttgcagtgaagaggagtcagaagtaagaattccagtggttgtcatactgtattttcttgactctaagaagcattttttcacatataagcatggttcttatgtagtagggttgttaagaagattaaatgggttaatacatgtaagacatttaaatcagtgcctggcatatagcaagcactagtacaagtgttagctgtcatcattattacagttattgaacaatcaatatatacatttaatgtagtgttttttaacatgaaagcagtaggtttcttaataatgaatgacatcttagaatggtgagattatagaccaggtgtaagataatgagggcctggaaaagggtggtagttgtgagaattccaaagaagtaagtctgagagagattaaaaaaagaatcgacttgatgacatattggatatagtgaattaagaaaaaggaaaattctaagacaaccctcagattgcacacctgaatgaatgggaaatagcttggcttaagaaagaaatgttacttgatctgtataaagtacttataacaatgccttgcacatggaaagcattatttttgttagttattagtagtaggactatttacacctgttatatacttaaatttgttatcaggtaatgtaataaagctaccaaaatatgaaagaaccttgtacataatttactagtagagaatttatatgttcaagggaaaataaattatgtgttttaaatatttttcagtataaatcaatgaggaagagttcaagtggcaatgaaaatgatgaggtgagaaaagataatattaataattatttgaaatgtttacttatcatatgaagttggctcagtgagagtaaaatgtaatccatttttcagtttctttgttattgatttaatgcatggttttttttcaacaataaaaacatatgagcatcatcatacaattattaatttaatcatttaatttccatatgtcctttagaatggaattactaataattcagttttagaattttatcatcattcgtcttagacctgtcatatgtgagtgtgtgttgtctttcacatcttttatctttctaaatcagcctggtcgtcaattgagattttttttaggaactttgtttaggaactccttccacaaattctgcatgctattttaaaatttaaaattcgacttctacagtttgtgcattaccataaacctttctactgcacagtgtaaactatgcagcagcctatcattgttgaaaagatatattctcattaccataaatacttaagttttgtgtatttttgttggagagattggtatttaatttgatgttgggtacttggcagggcttctgaaaatgtcttcagttttaggaaatagaatcacacagggaaaaataatgaatagagccagatgattggtcgtctgccagctcagatgccgatttctctccattggcctctccagtagtatttactgggatgaataaaagtcagttatggctatagctggtcatattttcactgttagtatttatatttaagcctaaattacatgttttgtatgggtatgcttggcaatatttacccatgcatcagcacaatcagttcctgtacacctgcccaagctttccattgcaccaactccacaagatcccagcctaccctttaaatattattcccagggaatggcctactgtgtggtctctagcatgtcttcaccagctgtcaagccttcagtgaataacacctgtgtacctgctgaagcctctcagatttgtctgtagtccagacctctcccctgaggttcaagcccttgcaatattttatccatcttcctacctgcttagaatttctgctggatatatctcataaacccaataggactaaatatgttcaaaactgagtttttaaaaagtttttgcttctaaacccactttttcgctaatatccgacagtttgtgtagtggctctcaactttggctgtacactaaaattaccaggtgagctttagacaatactgtcgcctgggtcacaccccctagatattataatttaattgacatgtggtatgttgtggtatggactgagcaatgaagtttttaacgtttcccatgtgagtttaatgtccagccaaggttgagaactactgagttaatggaatcaccttccatcatctagctggagcaggggctggcaaattatgatccaggggccaaatttgacatgctgtatgggattgtaagtaaagctgtatcagaaaacagccatactcatttgcctatggctactttttcattactgtggcagtgtttgagtatagtagctctccttttttctccatttcactttccaaggtttcagttacctgtggtcaaccacagtctaaaaataggtgagtacagtacaataagacacttagagagagaccacatttacataacttttattacaatacattgttataattgttctattttattattagttattgatgttaatctcatacctgatttataaattaaactttatcataggtatgtatgtataggaaaaaacatagcacatatattataaagggtctggtactatctgtggtttcaggcattcactggggttcttggaacatattcctcatgaattgggggacagttagttgtcacaaagcctaaaatatttgtcatctgcctttgacagaaaacattttcttatccctgcctcctcataccctcttttctcttgcctgcctcaatatctaatcagcagccaagacttactgtttgtttatttgcactaaaatattttgcatacattccccttttatttctactgtttctgctccggcagaggccctcgtccatttcttgcctgttctactgcaataacttccttgcacttctccctttctctagtccattctcactgcagccagagtggtcgtttcaaagaacacagatgcaatcaggccattcccttgcttggaaaccttcagtttccccccataacttagaagataaattctagatcctcctttatcaagcccttgcttgccacatcagccttaattcacaacttgctcttctttcaccttaccctccattcaccttaccctccaacaagacaaaactgctcagaggttttctgcactcatctttacatttgttgcttccatgctttggttcttctcctctcatcttagcatgttgttcccttctttctttttctggtagacactcagttttttactgaatttatactttctcaggaaacttgcctttctctaccatcttcatcatcccccccaagtgccccttatctgtgcctcataatatgccatgcattgttctgtattatactgagaatgttgtattacctgtatacattaatctatttctgtcctcgactgaaaggtccttgaatgggtgatattttactaaatttcagtactctcactgtctagcatagtgtctgacatatagtaggtagccaataatcatttgttgaatgaatacattttctatgtagtgtgcatattcaaagttaaatgtcaaaattttcatatttggttggcagtagaatagtcatttaaaaatcatggaccatttaatgttttattaaattaaattctttgtaattatcaataagcctatattagatacatgtaaattttcagatgaaagttatttggggtgatggagattttgcatgccttcatttacatgtctcagattggtaacacgtccctgctattatatgtagatagtatttttcaaactttactatatttcgaaccacttgagggtcttactgaaatgtagattctgattagttaggtctcgggtgaggcctgagattctgcatttctaaactcccagaggatccctatgctgctggtttacagaccacatgtagagtggcaatgtgctggatggcatatctttagtaggtcttcctttagtagttggtcagaacaatttttattttccttttatatgtttaaatcatcatttgtattgtaatttcatcttccatctttttatttttatgttttagcaagacagtgataatgctaatatgtcaacacaatctccagtatcatctgaggtacaagttctgtttttatttgtcttaaaaatacgttttgtatgttttctgtgttttacataagagtcttccttgccagttctctgtaa

SEQ ID NO: 1199 - DNA, 68577 bp, mus musculus
cagtctgcgcatgcgtcctaagaaccccttacactcgcggcacaggctgacagtattgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaaggatccttctacctgcaggacaaagtttaagcatcctagcttggcattcaggactttcattgttgggctccactttattgttgcaaccttattccccaaaatgctcccacatagaatcctctcttccaactaggtcaactctctgtctctcaaatacattttgtgcatttctgcctcatctttgtacaagatcatctgtatgcttgggatttccctcttttctccgtctatttaattttattgaagccccagctcttccaagaaattgtctccaactcccttagtccacaagaatctcctgtttctttgaattcccatggtacttattgtctttaccacttacttggcagtgctggttttattttctttttatgtttctgtcttgctatccctgagaagaaatagagccccttaaaaggcagggtgtaagccatatacttgttcagtcttcttattatatatcccctttattgtatttgataatatttctcataaatatgaatatcatctgatgcagttacagcctttggcttttaagccttcagttggttttctgaggcaagcttcaacacaaagcagaaccatatctgttcatggtaaacattcattcatcataagtttcattttactttttctcttcagttgaatgagcatttcttgtgggaacatttcaaaaatcagagtaaacaagatcttgtgctgctcttttttttcatttaaattagatatctttgggtgactcatttgccatttgtttttgataaaatttagccacgaaatttttaggggcagtattttttaatgtagagagaccactattcattatgtgtaaatgacggcaggtacattggaactgaagaaaaatagagtgtgtttgagattatacatacatatgtacatacatacacacacatacatacaggaacacacatacagtatattctctatttgatgaaaatgatctgtttggtgatcttgttatacttaaaatgactcagtggaatactgtttcagaaccaaaccgattagttagacaagcattccttattgcattaggaagagacaagaggaagggaaaatagctaagaagcggttaatgttaatctaggtgagaggtggtgagaatctgggtgaaacaatattgaataaggagaaattaatacatttcaaaataaatgggggaaggtttttttacattaagatgaaatagacccctggttctccaccctggctgcacattacaattgcaagggagattttttgtttgttttttcaaccctgcctggatcccaccctagaccaattaaatcagaatctcaggggccaaggaacttaaggaaaaaaaatcttcccaggtaattctaatatgcactcagggctgagaaaccctaaaattgtttattttttaagcactcaagaaatatttgttctttgagtgaataagaacattgataaaagtttagttattaaccttaaagccacttgtcaagaaagtcaaaaccaaaactaggaactaaatactcaaaaattgtttcaaattgtttgataaatttacgtgaagaaaatgatgccccctaaacatgtagcagcaaaatcttttctctgctaacaggcttcctatgagggaaaatgtattttaggcagctgtttgcagagtttatctttggtgtctttttacctctctctgcatttctagtgtctgttcttcacttgcctcctccctttgtccccatcacacttttctcctttctctttctctcttcaacctcactcctcttactttattgggatagagctcaggtaaatgattatggcagcctctctaggagattaacatttaaaagggggagtttgctaatttacttgaatctccaattggtgattggagattcatgacctttttgagtagatctcccttccagatactccttgattaaaattttcacccacataaggacataaaacagtgatcagaaagttggtaacccatttcagtaaagtagctgactcttgctgtaatgtcttctccgagatggtctgtagatagatttgacaagatgaagggaaattgcatagaactttttggtccatctggatactatgataatttgttgacttgaaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactcctactttggaaacatgattatggctaataaaaagagacatggtttttgtacttaaaggatttatacaatagtcaaatgtatacagtaatataacgattagaaaagaatttcactataatatataatagtattcaaaataatatattttaatatactgtacacataagagatctggaactgtggcataaggcttaattttagaggggattaatttagtttgagaaagcttcctgaaaagttaggttaggtatttgttgcatgacaggtataagaacagaagtggttgattgggatgttttaaaattggggttagtggaatacttttgcttaaggtttaaatttaatatttcaatttagattatttgtgatataaattctgaagcatttatttggcatgaaggtagacaagatccagaacctcactgagaacataagaagtaatgctagggacacttactacaaataaagataattgaagacttacaaaattgatttgctgggaggtgccatttgtttaagttcctaggcacacagtgaaactttgcaaaagaggcatcttgttctcccagcccagcctagcagcccactctgtgagatgccttaactgcatgatacacacctccccattctgcagaggctagtgatcatcatgacctagaaagggaaatattttagttttctttttttctctacactttgagtgtatttgggtgcttcttaaaacattgtaatactcttataatcagttatctggaaagtttcagaaagggttgtctgcttctcatttacagaaaaaaaaataccttacacgccagggaaccatttaatgtaattaaagaaaactgtataagccaatttaataacaatgtaagtttatgtttactctcactttcagctagtgcactcaatctgctaaaggtcaaactgtaatgtttaatctttacatttctcttgtttcatgtaaatagatagcattccattaacagaatacctgtcaatggactgtaatggataattcaacagtagatattttctaatgtattttttatatcaaattctttgaggaaaagttttttccaaataggaaagtaagttctttccttttcaggaacacttgattctgtgtagtcttttctaatttgtgacagagaatgttgtcactttatttttagattaattacttgtctcagtagaatattagagattcaaggtgacaagagacaggtataagataactgtgacataaacttttctttgaaccatatggagatgaactgattctagaacatttgtgaatttggatttcactcagaaatggctttttgttaatgattatgttcctaagagaatctagtatgtatagtctagagtttttcacttcttaaaaaaataattgcaatacgtaaatccttagtattttgagctacttggttggggatgtctatgtcaatgggaaataattacatttaaaggtttttgtgaattagaaatagtaaattaaacatagatgactgtgtccttaaactaccttaatgagtatgtaagaatggatttgtcatatagatattttgtaaaggttgtaaagttgctgctttcagtgagttaatgatttcataatggtttaaaataagaactcatatacctattatatcctagatcagtagttctcattgtggggaagggtagggttggagaggttgcctccagaggatatttgacagtatctggagacttttttttttttttttaagagacaaggccttgctatgttgccctggctatgttgcctgggctggaatatagtggctgttcacaggctctaactcgggggctcaagtgatcctcctgtctcagcctgctgagtagcttggactatagtcctgcagcaccacacctggctgaagacatttttgattatcacaatttgggggttgctactgacatctagtgggtagaggcaagggatgctgccaagcatcctacattgaaaaggacagccccatacaacaaagacttaacttgtctaaaatgtccatggtgccaaggttgagaaaccctgggttagagtaagataaatggaaagtgcagcataggttcaaagagggagggataacatttgatttggtcgtttgaacagcagaggggggctttataaagaagttggaggattggcctttagagaggaggcatcagattttatagttattcttagatggaggaaactacatgaatgctgatatctcagagtctcctcaaactcaatatgtcaaataatgaactctcgttattcaccctaggcccccttgtcacccagatctaaaacttgggagttattctccactcttccctttccctcagcctctatatctagtgagggactaaggcctgttggtcataactctttgaatagctttcagatcagtttcattcctttctattctcaatgtcattgttcagattctcctctattccttacctttaactggacctgtcagtagttttctaaatgatctctctgtctcaagttttcttcaacttaaattagttagtcctccacactgtagctaaaccattctttctaatatgcaaatctgattgtcatgtgttactaaaacaatgttactaaaacaccttcaagccagtagccagttttcaagccgtacgtttcaaaatcttatttccttattccttgttttgaacattaaaaaaagtaatacatacactatgttttatttaactgtggtaatttttatattttattagttaaaattaaattgctaagattcatccaaattgttatgtaaaactgtggttcattcttttggatggctgtgttatcttgcatcatgtgaatataccatctttattcactttctcactgatagccattttcattcccccctcctcctttttctcttgggaatagcactactatcattattatacatgtctcttgtacttgtgcaaggatttctcttgtgtatatacttgaaaatggaattgctgggttgtatagtatgtcagtgttcaaaccgatttatcatttctgtttccattgacatgtataggagatcctatgaatctatgtgccctccaaaacagtactgtcaaatttaaaaattttgaccaagtgtgtttaaaaaggtatttcgatgaagtctttcttgatttacattcccctgatcacgaatgatgttaacctttcttcagatgtctgttggtcatatgtctttcctgtactgtgaaatagcttttcatttattttgcccattttctgttggttggttgtccttttttaaaaaatagaattctatgggtttaaaaaaatactccttatactaatcatttgttttgtatattttgaatatcttgtttataacttgcctttttgctctttgaggggtgttttgatggacaaatttgtaaattttaatacagccaaatgtatcaatcttgaattttgtagtcaatgatttctgtgtcctgtttaagaatatgtaaaatatattcatctacattttttactaagagttttagttttgtttttggtattaaagttcttaattcatatggaatcgatttttatgtatagcacgaggtggagttccatgttcctgtttttacatatggattatcttttttcagatccatccttacctatgttggggctcagaaaacaatacccccaaatgaaggcctcagcagcagcctcagaagcagaagttttgcactgactttgtcctgccctcctgtctctctgtcccattctcctccaaggctagccgtagaaactagaatccctcttccccaaggaggatcacagaagccagaaccccttttcctgaaagccagccataagacctaaaaatattactctaatttcccctctgcctttctgtgtaaaaactggacacaaagaaatgatctaacctaccttgtttgactgtaggtcttaagacccccattccagagagggccctgccccacagtcagaaggaaggaatacaggctcagagaggcctagaagaatctatttaataggcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacctccgcctcctgggctcaagcgattctcctgcctcagcctcctgagtagctatgattacaggcgtgtgccaccatgcctggctaatttttgtatttttttttttttccagtagagacggggtttcaccatgttggccaggctggtcttgaactcctgatctcaggtgatccacctgcctcagcttcccagagtgttgggattacaagcgtgagccaccgtgcccagcgtgagtcaggatttcattgtggatttgatttgacttttcctcatgactaatgatgttgaacatcttttcatgtgcttattgactatttgtatattttcataagcaaaatgtctattaggaccctttgtccatttactaattggggtgtcttttcattactgagttgtaagaggtttttttaaaaaaaaaattctatattcaagttttttatcagatatatcacttgcaaatatttctttcctattctgttggttcatctactctgaaacacaaaattaaaacatactgatatcacctattttatctattttcttatgttgcttgtgctttttgtgtcatgtctaaggaagcattgcctaacccagggtcagaacgatttatccttatgtattctgagtttatagttttagctctttcatttttttacatttagctttactgcttatttaagttgatttttgtgtgtcatgtaagatcagggtccaacttcattcttttacatgtgggtatctagttgtcctagcaccattttttgaaaaggtcatttttttcttcatctgattgtcttgtgacccttgtttaaaatcagttgaccataaatgtcaagatttatttctgaactctcaattgtatttcattgatctatatttctgttcttaacccaataccacactgtattgattattgtagctgtgcagtaagtttggtaattgggaagtgtgaattttccgacatttttttcaagatttttggggctattctgggacccttgcatgaatttcaggataagctacacaatttctttggaaaatgcagaatgcaagttgggattttgaaaaggagtgtgttgaatcatcaatttgggggaattttgccatcttatcaatattaagttgtccaatccatgaataggggatgtcttttcatttatttatatctttaatgtcttttaacaattattttgtagtttcctatttttagtttttgatgttgttgtaattggaattttaaaaatttagtttttggattgttcattgctagtgtgtagaaatacaattgatttttataagtgatcatttatccttcaaccttgctgaacttgtttcttctagtagtcttttaaatggattcattagggtgttctatgtcatgtcatctgcaaatagagatagttttacttcttttcaaatctggagccttttatttctgtttcttgcctaattgtccccgttagaacttctagtttcaataatgttaagcagatgctgtgaaagtggacattcttgttttgttcttgaatttagggggaatatattcagtctttaaccattaaatataatgttagctctgtttttttcggtaaatggtctttatcaggtggaagaaattcccttctatacctggcttttcaaatgtttttatcatgaaagggtgttgaattttgtcaaaggctttttctgttctatcgagttaatcatatggtttttgtcctttgttgtattaacatggtatataatattgtttggtttttgaatataagatgaccccactttgcattcctgacctacctgcacttcagtttagtctcatactgcctcggacctctacattccagcctatcaaactataatatgtgctgctcgttgaaagtatcatgctgttcgatgcctcagggtttttctttttttttttttttcctgttaatatccttctttggctttccaccttgtgaactcctattgattctttgtatcccagatcaggcctttatcttttccctttcccctcatcttctacataacagtgattactctatacctctattatagccgctgtgattttgtattgcagtgaatatatttccttcaccctagtatgcaccatcaatttaataacttttctgacaaataaacaccacttcagtaaatgcatacatagatttcaaaaatgttagcattagaagaaaatatgcattgttgaattaaagaaatatgggttatttgtttgcatttccctttttattggttttagagttatttgagtatagtgactttgttgccactccagtagctagtagtacagtgtgtggtacatagtagttgtttagcatattttgttcaattaagcctgcttcttcccatgggtgcctttttgagtccctgcacaatttgtccctttggttttcctctgtgttttccactacttcataaatatataccctgttcttcagggtgtatatctgaacccctcattgttttcctgatttttgtttttattgttttgttatttttaaaaatgaaaaaaattagaaaaaagacatatcttgttattgcttcataagcagatatatgagtattaaactttaacagtttggaaatttgctgtagtttatatatatatatatatatatatatatatatatattttttttttttttttttttttttttttttttgttaagatggagtcttgctctgttgcccagactggagtgcagtggcgtgatctcggcttactgcaagctctgcctcccaggttcacgccattctcctgcctcagcctcccgagtagctgggactacaggtgcccgccaccacgcccagctaattttttttgtatttttagtagagacagggtttcaccatggtctcgatctcctgacctcgtgatccacccgcctcggcctcccaaagtgctgggattacaggcgtgagccactgcgcctggccggtttttatatattcttatactatgccgctagatatgtttttattttagagtagctggccgtttaaaaatatttaggttagcgcttcattaaaattgatttgaaagtactgtttatgatgttaaataagattgacattgaaaatactacattacaaaatgttttgaggattaatatgttcttttaacaaattctattttgaaaatcacgtttgtagatgaagtccaggaaaaatttagagataaatggacatttcatgattaggtttaggagttttctcggtagtatagctctgaattgtttaaaattgtgttttagcatgtcttggtcttactttgtcctcttactgtctgctctcctccattagccatgtgcaaagttaagatcccaggatctgctacctttcagttacgaagtttatcatccttagtaggatcagagcttaaaggcactcacaacagctctctgtattcactgcttcttctcttgcaaaaagcctcatcacttaatgaatgactaaactttctcacatttatcaatataatattgttgccttaaacatctttccattgtagtctattgtatactcttcttctacattgttctttcagaaagttttccttatgccaccattccactgaagaaaaatgtatggatgcaccataacttatttaaccattcctctatcattagatgtttaagttactgtttaatattaataaacaaccaggtgtaattgtgctcctggctttacattgctttctccccagagaaatttaaacttctttaggacagataatgcattctctatataaattctcgacagtgtttggttcaatgctatgactctctgaaatagtttataatagatgcttctcaaatttttaaactttatgggaaagagtgtgacaattttatatactgacttcctatactatttgtgtgtaggacaatgcctctgccatggtgccttggtgatcttgcatgtacccacataggccacataggcaaggctcaaccacaatctgtctcaagtcttgggggaatactctgtgatcctccttgatacatggtaagatagacttgtgaggagctgtcacaaggccatttcctatccacctctgtatcttacaggaggcggcctcaaggcagcttattatctcctattttcattttggtaaggcatgggagtttccttcaggcacagttgtgactataaaatgacatagctgcagtctagaattgactcctcaacaacagagcaacccactgtgtgtgttgtctttcatttagtccctccagtttgggtttctcttgtaggactagggacatggggagctgataccatactgatcatgccttctctgcctgtgttagtaataaaccatctgaatccatttggtcttgtcttactggcagctgccgccgtgctgatgtgtaggggctgcttgaccacttaatgtaaacaaatgggattttttttttttccagtttgtggaatttgtcattactttttaattggtcaatttattgtaaattgcttttaatttcaggattcagtggttagtgctttgctatcaaatagctcaggtaaggatggtccttgctctgtaaatacagtattattttagggggtacagcatgcagctataaaattagtcttaatctgaataaatcaaagataaagcaattagttttgtttagtacagtggcctgcacttggttttcttttttcttcctctcttctcaaggactacttttgttttgcaatctgaagcctgcttaagttgtcctggagagtcagttggatgcagacctttctcgtattatattagactttcctttctcatgcagtagaaaggtactaaggtatcttaacatgcaaataaaatgtatattgtatacacagatctacctgattttcagtggctggttgaccttgacctaggcagaaagatcaaagtcaaactgttgccagtggagggtgtccaggttcttggtgttttgaacaaagaattggacaaaatgcacaaagcaaggaaagaatgaagcagcaaaagctgagatttatcgaaagggaaagtacactctacagggtggcagcaggccgagcagcctctcacagccccgatacagaatgttcttgggtccaaataccctgctagaggattcccattggccactttgtgtttacctcatataaatgaagtgatggcctgcaatcaatctgattggttgcagaaagcgatgaaacagagcctaaagtgaagttacaaagctgcactgctatgttaacgaagacttggcgtgcaatcagtctgattggttgcaaaaaacaaacaatcagaggctgaagttacaaagttatacgcctatgcaaaagtctgattggttacagaaagcaaccaatcagaggtactttctatttcccatctgccatgcagaaatagtgggggtttgccaaggggctagtctctggtccttttgttacttaggtgtggaaagttagggttttcctttcagtttagttctaggaagtcagcgtgaaacggccctgcctccagatcctatactcctgcctcaaaactaattgaacatcatcaattctgatgtactagacatggttaagatacatgttttgccattggttacttcattaatcagaataatcataacaattcagatattaggggttttttttggtttaaaaaatgttacatgaaagcatgattttgttgaattaattaattaattaacttttttattctttgagacgggggctccctctgttgcccaggctggagtgcagtggtccaatcttggctcactgcaaccccatcaaaaactgagcgaaggatatgaacagacacttctcaaaagaagacatttatgcagccaacaaacataagaaaaaaagttcatcatcacaggtcattagagaaatgcaaatcaaaaccacaatgagataccatttcatgccagttagaatggtgatcattaaaaagtcaggaaacagcagatgctggagaggatgtggagaaataggaacacttttacactgttggtgggagtgtaaattagttcaaccattgtggaagacagtgtggcaattcctcaaggatctagaaccagaaataccatttgacccagcaatcccattactgggtatataaccgaagcattataaatcattctactataaagagacatgcacacgtacgtttattgcagcactgttcacaatagcaaagacttggaaccaatccaaatgtccatcagtgatagattggataaagaaaatgtggcacatatataccatggaatactatatagccataaaaaaggatgagttcatgtcctttgcaggaacatggatgaagctggaaaccatcattctcagcaaagtaacacaggaacagaaaaccaaacactgcacgttcccactcataagtgggagttgaacaatgagaacacatggacacagggaggggaacatcacacactggggcctgttgtggggtgggaggccaggggagggatagcattaggagaaatacctaatgtagatgatgggttgatgggtgctgcaaaccaccatggcacttgtatacctatgtaacaaacctgcacgttctgcccatgtatcccagaacttaaagtataataaaaaaattgttatgagtttgggggtacaagtgtagttttgttacatggatatattacatagtgatgaagtctagactattagtgtaaccatcactcgaatagcgtacattatacccattaggtagtttctcacccctcaacccgctcctaccttcctacatttctgagtctcagggttctgcaggtacatagaagttgccaggttttcttgccatcctcgccattcgaaattcagttctgtacatctgcctatattcgttgtgatagtgcttcgctttttcatagataaccttcctccttgccttttgaagtatgttttgggcaaacttctttctcaggcacttgatcttcagttctgtaaaattcctttactttttcttaagggtttctggcacagcaggaaccttcttcatcttctcttctacaccctccatggttccagctggaaaaagaggatgatttcttttcttttgggtagatacctaatagtgggattgccagatggaatggtagttctatttttagttctttgacaaatcgtcatactgttttccccaggggttgtactaatttacattctcactaacaatatataagcgttctcctttctccatatcctcaccaactgttattttttgactttttagtaatagccattctgactggtgtagggtggtacattggctgtctcaaaattttgtctgttttaatttgcatttctctgatgcttagtgatgttgagtatttcttcatttcatatttttcattttttcatatgcttcttggccatttgtatgcatacaacaaaagcggtgcttgcttattgtagaacatttggaaaatagaagcatagggaaaaaaatacaaattgcttctcattccagcaaccttgaataaacattaatattttggtatatttcctttatattcccaacactcatcatcttgcacatacctgtaggtctttataaatttatgtatggtctttaaagaaaactattgctgcacttggtgtatatagttttacattttaaatactctagttattatactgtgagcatatttccatactaaggaatcgagtctataatatgatttttaaaggctacaggatattccatgttaaagatataaaaatttgtttagcctttatcttattgttggacatttaagttgtttctaatttttactattttaaataatcctgaaatatgcatattttttacatatctctattaggtttcaatcaaaaattgctattaattgaattattggatcaattattatgaacagttttaaggaccttgattcactttgccaaattgcacttcagagaagttacctcattttgtattcccaccaatgatgtatggaagtgcctaattcaaaatagccttgccaacaccaagtgatagttttaaaacctttaaatttgattaatgaattatgttttttttttttttttttttttgagatggagtcttgctctgtcacccatgtcacccaggctagagttttgtggtgcgatcttggctcactacaacctctgtctcctgggttcaagtgattctcctgccttagcctcctgggtagctgggactacaggcacacggcacctcacttggctaattttttatttttattttttgtatttttagtagagacggggtttcatcacgttggctagtgtggtcttgaactcctgacctcaagtgatcctccggcattgacctcccaaagtgctgagaatacagacgtgagccactgcacctggccaaattatgttatcataatttttacgtttattttgattacagtgaggttgaagatattttcatatgcgtcttggtcgttgatagttttcattttgaaactgtttatgtccttggcccaggttttatctatgagttgttggtatctttttgctttttgatagactgaagtttttccttctttttatgtaacttaacctagaaatctttcatgtgtgaattctttctttatattaacactttgaaactccttccccattctaatattaggtgactagtcactataatgtttttcttaaagcttcattttcatgtttatctttttcttccatctggattttattttagtaaaagttatgtgataaagcaatagtatttgtcttgaaaatatagttattcaatagccatttaataagtaatactacattgatttgaaatgacaaatttataatacattttataatggttgaagtatagtgccattcttaaatatctctttgatgtttgaatgctgttacagtgattcattagtcattatttcttggtgaaactgaaaaacttactagaatttcctacagataactgcatagagctgcccctccctcttcttttaaataaggtcttgtctttccatgtggcttaattgttgcgagactcacagtcctttccttactgagcatgcacgtatctgccctctggttagcagctgtggtttccccttgcaatatctgtttttgtttgcacctttgcttctcaaggttcctgtgctgaaaatgagcctttcattactggttgcttcaggtcggtgagatctccttgttattgtttatcataattgttaactttgaagcatttttttccttcattttttccaatgtctacaagttgtttttttctctctgctgcacttatggttaaaattttaattcatcatggagtagcttagaaattctgtaatccatacatcttacttgttcaacaaggtctcagtgttatagactgttcattattttgtcctgcacaacacccttctagggaatactgaatcaagaaatcacctgtctttgcagagggcatctgttgaggcagatgccagagccatggggttgtcatttcccatcaggctccatccagtatcagtctctaatacttcaaagacactttccatccttgcatccgacagacagctgtggtgccttctgttttcttgctgcttttgtttctagtcttaacagttcttttagatagaaaaatagatgaggaattgctaacatttgagaacatattaatcagattttacatactgtaattgtgctcaaatttgagtaataatagttaccaaagaacagagaacatttaattttttcattttcatgttaggaaataagtatctgagttggctgattttatgcactctcctgaagacatatttctgctatatattttttatgttacaagaaatgaatataatggtctaatttccatcattttattttctatctttatgaacattacctatcattatgtacaagttgacaattttcccttcatttctattgattatttcttctagggattttaggttgttgcagaatatttagtcattaccaatagctctgaaataggaattaagtgattttggcactatttaataggtagtagtagattcagaaatgcagttcagatcaagtctagtgttcatctcccctcttttttagtcagtaagacttctgtgaactttgagacataccccaaggatgatgctgtattggtctagccccaagagctttatattatagaaactacaattttagtagaactaaatggaggtgattctttttgcattctttcactgaagtgttactatctaagcaggtattatttggtgttggagtggaataagaattgatattacctagagttggtgtctggttgagcttttgatttaccctaacatctcatgcttagtttatagttaatgtttaatggaattttgtcaaatggatgataaaggctgtgagtcaagtcaggatgctacctggcaaatatggagaatgaggcttggaaggtgaggatcagaatttgcttgcctctatcacagactctggaaatgcaggacgacagataatttgatattaagatatttgaatattttaccttgtatgttttccgtggttaggctgcaacttctaagccctgctggaaaaggaatggtactgttcaaagacagttcaccatggcttcatgtttctgcgcatcttacaagtgagacactaactgccctgtgttctgaactttattttcaatgatgttggtacagtgaacagctttgcaagataaacctactgtttgccttcaaaacaaagtgcagactggacgcagtggctcacacctgtaatcccaacactctaggaggccaaggcaggaggattgcttgagcccaggagtttgagaccagcctgggcaacatagcaagaccctgtcctttttttttttatgagacaaggtcttgctctgtctcccaggctggagtgcagtggcacaatcggctcaccacagcctcaacctccccaggctcaggtgatcctcctgcctcagcctccgaagtagctgggactataggtccatgccactacactcggctatttttttgtattttttgtagaaatggggttttgccatgttgcccaggctggtctcaagctcctagactcaagcaatccaccctcctcggcctcccaaagtgttgggattgtagatatgagccactgcccccacccaagaccctgtctcttaaaaaaaatagccaagcttggtggtgcatgcttgtagtcccagctacttaggaggctgaggcaatagcactgctttagcctgggaggtcaaggctgccgtgagctgtgatcacaccactgcactccagcctgggcgacaaagcaagatactgtcttaaaaagcaaacaaagaaaacagaaacaaaccaaagcaaagggcagatttgcttgcatccttggacaaattagatagtatttctctccaaagcaaaagataatcatgcttaatgttgaataaaataaagataatgtctcccttagaataaaaggcaggcatgcttactatgataaaagatttgggttccctcagctcaggttcctttcctataatgtgataatactgcatgtgcatgcatccatctgggcccatcagtgttgcccccatgagattttggggagtacggggaactgacccaaatatactgttcatgccatttgctgtgctgtgagcaataaaggcctctgtctctcacacgggagtctcatgtcttctgctagcatctatacaacagtgttaggctaacatactggcttacaagtagggcaaaatccgacccttcagagttcttgacaggtactcagcacaatgcttttggctataagatgttatcctcctttagacaaaatttgtttgactaattttctttaatccttgtttattgaattggttaaaaatattgaaaagtaataagagcccatctctttaaggggccaagaaagctgtgtgtcatctcagatgaaacaattttgaattggtaaattgggaaaagctgagggctttataatggtgttcattattctctaaaacaaaaattgaacctagaagtaagatttacattctgcctcctattgcaagaagcaatcttgggggggtgtgtggatgttgttagatttagaattcttctgaccctggtgtgtggttgcagtgggacagaatatttgagatgtgggacagaaggccacagtagtgtgttaaaggagtggaaaatcacacatagaacataggctttgaagacacatgagtttggaaccccagtgctgtcagttattactagcttttcattttttttacctttgggaaggcatgtcattcagtctatctttgcttcatatgtgtattagtctgttttcacgctgctgataaagacatacccgagactgggcaatttacaaaagaaagaaatttgttggacttacagttccacgtggctggggaggcttcacaatcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcaccctctgaagccacggcccaagctgtaccttggccccttatagtcatgcctggagtggctgggacacagggcaacaagtccctagcctgcacaccacacaggggccctgggactggcccacgaaaccattttttcatcctaggccttcagtcctgtgatgggaggggctgctgtgaagacctctgacatgccctggagacattttccccattttcttggggattaacattcgggtcctggatacttatgcaaatttctgtagccagcttgtatttctcctcagaaaatgggattttcttttctatcacattgtcagggtgcaaattttccaaacttttatgctgtttcccttttaaaactgagtgcttttaacggcacctaagtcacctcttgaatgctttgctgcctagaaatttcttccaccagatactctaaatcatctctctcaagttcaaagttccacagatctctagggcaggggcaaaatgccaccagtctctttgctaaaacaaaacaagagtgtcacctttgctccagttcccaacaagttcctcatctccatctgagatcacctcagcctgggtttcattgtccatatcattattagcattttggtcaaaaccattcaacaggtttctagggagttccaaactttcccacattttcctgccttcttctgagccctctgaactgttccaacttctgcctattacccagttccaaagtcacttccacatttttgggtatcttttcagcagtgccccactctactggtaccaatttactgtattagttcattttcatgctacagataaagacatacccaagactgggcaatttacaaaagaaagaggtttattggacttacagttccatgtggctggggaaacctcacagtcatggtggaaggtaaaaggcacatctcacatagtggcagacaagagaatagagcttgtgcagggaacctcccctttttaaaaccatcagatcttgtgagacttattcactatcatgagaaaagcatgggaaagacttgcccctgtgattcaattaactcccaccaggtccctcccacaacacgtgggaattcaagatgagattttggtgaggacacagccagaccatatcagtatgttaaatgagaaacagtaactagcttacaaaattgttaaaaggattagaaataatctatgcaaagtgcacagtactgtgatctagcatatagggtgtatgtgtataatatttgcctcaattccacttaggttattcttgatgtgaatttagagttctgatttcaagttatttctccattaactcccatgttccttcaagcagacaattctatggtgattactctaatgatgaagatgtgttcaaacagcacacttcattattaggaattttatcagaggtaaaaatcacatggccctctccttaatgtgtctgtttaatttccctctgctttcctcttataaggatacacgtgatggcatttttagggccagagataaaagtgtgtcaggctttcaaatattacctaggatttttttaaaaggagagactatggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaacctttagcatataagataacactcacagattccagaattagggtctgatatctttgagggccaccattcagcctacaacaggaagataaatacacattttaatgtccttttttatgtggaaaaggtgaaccatttttataattgtcttttcccaagtgctgtttgttgcctaagaaggtaggctttgaaattgttgtgaagtgaatctcccacggaggaataagtgagcagttttccgatttttatttatttttattttttgaaaaagacagggtctcactgtcacccaggcatgagtgcagtggcatgatcatggctcactgcagcctcaacctcctgggctcaaaccatcctcccacctcttagcctcccgagtagctggaactacaggcatgcaccatgcccagctactttttgtatttttttgtagagatagggtttcgccatattgcccaggctggtctggaacacctgggctcaaatgatcctcccacctgggcctcccaaagtgttgggattacaggcatgagccaccgactgcacccagctgtttttttttcccccgatttttaggtggaatttttatttatttaattttttgctggaactcagttaaaataccagttttgcatgtatttctcaattatttgttcattattagtcatattttatttttctagttgccctagtatacatgttaattgatttttaatgtttaaaaagctcctttattgtatatcacaagataaacattttaaatcagtttaaattttattaattatagctatataaaagttaatcttcacttttttgatggaaaatatgagatgctgttagtgtgagatagttcaagaaattaagatacaaatagttttatgttatttcccatttttctttccaaggttgagtttttttttttttttggcactgttattgtatttacccaatgcttaggatgtttatactgattttaaatctgaaacacctaagaattagattttgctgagaccagctcagttgtggagaccctaacccagcggcgctagaggaattaaagacacacacacagaaatatagagtgtggagtgggaaatcaggggtctcacagccttcagagctgagagtcttgaacagagatttacctgcatatttactgacagcaagccagtgataagcattgtttctatagattatagattaactaaaagtattccttatgggaaacaaagggatgggctgaaataaaggggtgggtctggctagttacctgcgataggagcatctccttcaggcacagatcgctcatgctattgtttgtggttcaggaacacctttaagcggttgtctgccctgggtgggccaggtgttccttgccctcattccggtaaacccacaaccttccagtgtgggcgtcaatgccatcacaaacatgtcacagtgctgcagagattttgtttatggccagttttggggccagttcatggccagatttgggggcctgttcccagcaagatttattattctttatttaactccattaaattagaataataattataattttaagtggtgtttactaaataaatacatgaaatcatccagaaaatagtttatgaatgcacatttaattaaattccctgagggagcttctaatattactttgtaatttaactaaataatcttttatttggaggggaacgaacataaagaagcatgaaaaatgtgtagattagtaatgtcttgatattatttaaatcattaaattattcttgttattaatactgatgttttagtatatttttctgtccctttttggtagtttatttgcctttttatttcatttttttttgcatttttttttgtgagacagagttttgctctttttgcccaggctgaagtgcaatggcgtgatctcggctcactgcaacctccgcctcccaggttcaagtgattttcctgcctcagcctcccaagtagctgggattataggtgcttgccactatgcctggctaattttttgtatttttaatagagacagggtttcaccatgttggccaggatggtctcgatttcttgaccttgtgattcacctgcctcggcctcccaaagtgctgggattacaggcgtgagccaccatgcccagctgactttttatttcatatgttatttttcagaagttttaggtttacaaaaaaattgagcagatagtacaggtaccccatactccttttctccagctcatagttttcctatttttagcatcttacatttttgtaatgtattttttacaattaatgaaccaatatatggtacacttgatgatgatgaaaattgatgaagctatactttattattaaagtctgtacattaggattcagtctttgtgttgtatagttgtatgtgttttgacaaatgcatgtgtcatgtatgcatcatcacagtatcacatagaagagtgtaactgccctgaaaattctgtgatccatgtattaatcactctttgatatggtttagctctgggtccccacccaaatctcatattgaattgtaaccactatgtgtcaggggagggacctggtaggaggtgattggatcatgagggtggtttccccgatgttgttcccatgatagtgagttcttatgagatctgatggtttataagtgtgtagcattctcctcctgccctctgccttgtgaagaaggtgcttgcttcttcttcaccttccaccatgattggtttcctaaggcctccccagccatgtagaattgtgtgtcaattaaacctcttttctttataaattacccagtctcaggtggttttatatagcagtgtgagaatggactaatacagaaaattggtactaaagaagtggggcattgctataaggaaacttgaaaatatggaagcaactttggaactgggtaatgggcagaggttggaacggtttggagggctcagaagaagacaggaatatatgggaaagtttggaactctctagaaacttgttgaatagttatgaccaaaatgtgatagtgatatgaacaacgaaatccaggctgaggtggtctcagatggagatgaggaacttactgggaactgaagtaaaggtcactcttgctatgctttagcaaggagactgatggcattttgctcctgccctagagatctgtggaactttgaacttaagagacatgatttagggtatctggcagaagaaatttctaagtagcaaagcattcaagatgtgacctggctgtttctgaaagtgttcagtcatatgcattcacaaagagatggtctgacattggaacttatgtttaaaaaggaagaaaagcataaaagtttggaaaatctgcagcctatatggtggaaaagaaaaacccatttactgggaagtaattcaagcccgctgcagaaatttgcataagtaaaaaggagccaaatgttaattgccaaaagaatggggaaaatgtcttcagggcatttcagagatcttcatgacagcccttcccatcacaggcctggaggcctaggagggaaaaatggtttcatgggctgggcccagggccctactgctctgtgcagcctcatgacatggttccctgtgtcccagccactccagcttcagctgtggctaaaaggggccaaggcacagctcataatgttgcctcagagggtgcaagcctcaagctttggtggcctccacatggtgttgggcctgtgggtgcttagaagacaagagtggaggtttgggaacctctgcctggatttcagaagctgtatggtaatgcctgaacgtccaggcagaagtctgctgcagggccagagccctcatgggtaacctctactagggcagtgtagaggggaaatgtggggttggagactcacacagagtccccattggggcagtgcctagtgaagctgtgagaagatggccactatcctccatacctctagactgacagtttgtaccgagcacctggaaaagctgcaggctctcaatgccatcccctgaaaccagcgacgggggctataccctgaagagccacaagggtagagctacgcaaggccttgggaacccaccccttccatcagtgtgctctggatgtgaggcatggattgaaagaagattattttggaactttaagctttaatgacttccccattgtattttggacttgcatggggcctgaggccctttgattttggccaatttcccccatttggaacgtgtgtatttacacaatgcctgtacccccattgtatataggaagtaactaacttgattttacaggctcataggcaaaatgggacttgccttgtctcagatgagactttggagttggacttttgacttaatgctggaattagttaagacatttggggactgttgagatggaattttgcaaatgtgttgcagtgtgataaggaaatgagatttgggaagggctgtggcagaatgatatggtttagctctgtgtccccactcaagtctcatattgaattataattgccatgtgtcaggggagggacctggtgagaagtgattggatcatgagagtggtttccctcatgctgctctcatgatagtgagtgagttcttacaagatctgatggtttataagtgtgtggcagttcccctgccctgcctgccatcttgtgaagaaggtgcttgctcttcctttgccttctgccatgattgtaagtttcctgaggcctcccagctatgtggactgtgagtcaattaaacctcttttctttataaattactcagtttctggtagttctttacagcagtgtgaaaatggaccaatactctcttcctcttcccttattccctcttttcctcccaaattatggcaaccattgatctttctactaccaccatagttttacccttcccagaatgatatttactaggaatcctagcatatgtagacatttcagactggcttctttcaagaagcaatatatgttaaggtctctccatttcttttcatggcttgaaagcttgtttcctggaagctattccattgtatggatattccacagtttatccattaacctattgaaagatgcatcttgtttgcttctaaattttgacaattatgaataaggctgctataaatgttagtgtgaagactttgtgtagacattagttttgaacttatttgagtaaatacccaggcttgcaattgctgaattaagaccatatttatctttgtaaaagcataccagactgtcttccagtgtggctgttcttgttttttcactaaaaatttatttatataatttatggcatacaagtgcaaatttattacatgcatagtagtcaagttaggggattcagagaatctgtcacccaaataacatacattgtacccattaagtaatttcttattatatacccctctcccactctctcacccttctgagtctccattgtctatcactctgctctctatatctatgtatacaccattttttagcattcactaaaaaatgagtgagtgacaacatgtgatatttttctttctgtgtctggtttgtttcacttaagataatgaccttcagttctatccatgttgctgcaaaagaccaatgctttggctatttggactcttttttggttctatatgaattttatgattgttttttctaattctgtgaaaaatgatgttggtattttggtagggattgcattgaacctgtagattgctttgggcagtatggtcattttaacaatattaattcttctgatccatgagcatgagatatctttccatttgtttttgtcatcttcaatttctttcatctgtgttttatagttttccttgtagagatctttaacctctttggttaaatttattcctaggtattttattttctggtaggtgtggtaaataggattgacttcttgatttcattctcagtgagatcattattggtatttagaaatgctactgtgttttatatgttaatttttgtatcctgaaactttatcaaatctaagagttttttggtggagtctttaggtttttctagatataagatgatatcgtcagcaatctgcgatactttcacttcctcttttttgatttggatgtgttttatttctttctcttgcccgattgctctggctaggacttccagtactatattcaataacaatggtgaaagtgagcatctttgtcttgttttagatcttagttggaaggccttcagcttttccccattcagtatgatacatgggtttgttgtatatggcctttatttttttcaggtatgttccttctatgcctagtttgttgagggtttttttaccatgaagggaagcttaaccttatcaaatgcattttctgcatctattgagatgatcatatgttttttgtcctaattttgtttatgtgatgtatcacatttattaatttgcatatattcaaccatctttgcatccttggtataaaacccacttgatcatggtgtatgatatggtttggctctgtgtccccacccagatctcatcttatagctcccataattcctatgtgttgtgtaagggatctggtgggagatggttgaatcatgggggtgggtctttcttgtgctgttcttgtgacagtgaatgagtctcatgacatctgatggtttcaaaaacgggaatttccctacacaggctctttgcctgccaccattcatgtaagatgtgacttgctcctgcttgccttccacaatgattgtgaggcctccccagccatttggaactgtaagtccaataaacctctttgttttgtaaattgcctagtcccaggtatgtctttatcagcagcatgaaaatgaactgatacagtgcattatctttttgatgtcctgtattcaatttactagtattttgttgaggattcttgcatgtatgttcatcagggatattggtctgctgttttccttttttggttgttgtgtcctcgtccagttttggtattagggtgatagtggcctcatggaaagaattagggagaatactctcctcttcaattttttggaacagtttcaggaggagcggtattccttctttttatatttgatagaatttggctgtgaatccctcagccaagctccctcaacaatccctgagcttgtctttattgggattttttttttttttactactgattcagttttgctcttcattattggcctgtttagattttctatttcttccttgttcaatcttggtaggttgtatgtttccaggaatttatctctttcctctaggttttcttgtttgttgagtatatagttgttcataatagtttctgatgatctattgtgtttctgtggtatcagttgaaatatttccttttttatttctcattgtgtttatttggttcatctctcttctaggttagtctagctactggtttatcagatttatttatctttttgaagaatcaactctttgtttttttaatactttgtatttctttggtccctatttcatttagttctactgtgatctttgttatttcttctgctagttttgagtgtggtttgttcttgattttctagttttttgagatgcattgttaggttgataatttgtaatctttcttttttttgataataggcatttaatgctacaaatttccctcttaccactgcttttgctatatcccacaggttttggtttgttgtgtttccattttcatttgtttcaaaaaatttttaatcttttgtattaatttcttctttgatccaatgattgttcaggagcttgtgtaatatccatgtgtttgtatcgtttctgaagttcctttttgtattgatttctatttattccactgtgttatgagaaaataattgataggatttcatttttaaacatttgttgatacttgttttatggcctaacgtggtttatcttggagaatgttccatgtgctcatcgaaagagtgtatattctgcagttgttgggcagaatgttctgtaaatttgttaggtccatttggtgtaaagtccaatttatatctaatgtttctttgttggtttcctacctggatgatctgtctaatgccgtgagtggtgcgttgaagtctcccaccattattgtatctgtctatctctctctttaggcctagtgatatttgttttatggatctgggtgctccagtgttgggtgcatatacatttaaaattgttatagcctcttgccagattgatccctttattacagaatgaagttctttgtcttttttaaccgtcttttatttaatatctgatttaattgatgcaagtacagctagtgctgctcacttttggattttgtttgtgtggactgtctttctattcctttacttttggtctatatgtgtctttacaagtaatgtgagtttcttgtaagcatcatatagttggattatgtttttaaaatctattttgccaatctatatcttttaaatggggcatttaattcatttattttcaaggtttatattgatatatgtgagggtttgttcttgtcgtattgttaattgttttctagttttataaattctctgtttctttttcttggaatgtttgcctttggtttggtggaattctgtagtggtgccatttgattcctttttcttcctcctttgtgtgattactttaccagtgagttttatacttttgtgtgtttttatgatgatgaatatcgcttttacttccacgtttaggacttctttgagcatttcttgtagggccagtttagtggcgatgaattcctcagcatttgcttgtctctgaaagacttcatttcttcttatttatgaagcttattgctggatattgagttcttggctggcagtcttggttttttttatttcagcatttttaatatgtcattcccttctcttctggcttttaaggtttctggtgagaagtctcatgttagtctaatggagtttccttatgtaggtgacagggtgcttttctcttgctgattttattttattttattttttctgtgaagctgttctttatttcagggagaggacaggacagggagctcagtctttcatagcagcaactttcctcgtgatggccaggacattgctcagctcctcccgcttcctcttggtgtggatgtgtgtccccacccttttcttgatgaacttgagggcttgtttgtccttggagaccttcagtaactccatggtgcaccgctcgtatggggtgaagccacatacctcttggatcatgccccgcacacacttggtgtgtttggtcgggcgcccaaggctacgactgtgtctgggcttgctcaaattcttggtcaacttgtggcccttgttgaggcccacgaccatagtgtagcacagaaccattgctgctgctctgcaatggtggctgtggtggaatgctgtcttgctgattttagaattctttttactttagacagtctgattataatatgctgtggcaaactcctttttgcattgtgttttcctgggaatcactgagtctcctgtgtctggatgtctaaatcttgctatacttggaaaagtttcgtttcttattttgttaaataggctttctaagccttttaatctctcatatccctcaggaataccaataatttgtaagtttggtcattttatgcagtctcaattggcacatgtatacctatgtaacaaacctgcatgttctgcatgtggatcccagaacttaaagtataataaaaaaataaaataaagcaataagcaagttcaaaaaaaaaaaaaaagaaaaagctttgttcattctttttctttatttttgtctgactggattatttcaaaagacctgtcttcaagttctgaaattctttcttctgcttgatctagtatttcaaatgtattttgtattttcttcaatgaatcctttagtttcggaatgtgtgtgtgtgtgtgtgtgtgtgtgtgtgtgtgtgagagagagagagagagagagagagagagacttgttctgttgcccaggctggagtgtagtagagagcgagagtgagagagagagagagagagaaagagagagagagactttttcttttgcccaggctggagtgtagtggtgtgatcatagctcagtatgacctcaaacttttggactcaagtgatcctcctgcctcagcttcctgagtagttgggattacaagcatgtgccaccacgcctagctaatatttgtatttttagtagagacaggttctctctatgttgcccaagctggtcctaaacacctgggctcaagcagtcctcttacctcggcctcccaaagtgctgagattgtaggtgttagccaccacactcgggctttttatcttttaaagatatttatctccatgttataagtttttatttgtattctgaattgattttctgagttctttgtattggtttttagatttctctggcatctcattgagcttctttaaaatcaatgttttgaattctttatctgggattttgaggatttttttttcttttttggttaggatctactgctggagaattattacattcatttgaggccataatattacttagctttttcatgttttctgtatctttatgttggtttctgctcatctggcttcatagttacatctttttaaaaaaataactttcacgtggatgggggacttttttcttgaagatatgacaatgatgttcgttgggtaaggccttctggctttgcttccaggtgcatgcagtagtgaagactctgtataatttgtatggctatccttattctgttaatgtgttgttcttggtggggcctgtggtgaagttgtgcttgtgactggaatgcctgatgggcccatcatcaggttgtaatggtagcagaggtgtgctaagtatgtctatccttgtgacctgggacagcatatgctggctcctgtgttggcagtttccaggcaggctcatgtttgggcatctgggtggcttcctcagatgccagttttagtagcagtataccaggcagataagcaggctctcaagctcctgagcagttggagtagtgtgggtgatagaggtagcagtggtggtgagatagtctccttgttcccatgcactgtgctcttgtgttggaagtggttgcaacaggctgtgcaaactggcttctaggccagaaggtggtgctttcaggtaagagccagctgagactgtagaagcagggtgtttatgctcagtctctgtccccttggtgctcatgtgcccctggtggtagattgggttgtggaacacccagaacctggcccccacagttcatgttggcatagggttaggagggtgaagctgggtggatccagactgggcaagcttgtactcaacacctcccaatggcaagtgcgtgcatgagccatgatgtgggggtggggcaggcagtgtagtcgtcatgcccctggtgaaatgcttgggtgagaggtgactgctgctgtgctgaggtcctgccatgggtgccagggaggatgagaccactgctgtccctccctcatcccatctgtggcagccaacctggctgttctgttagtatggcagtttgcacccagcccataattcagccatgagccatagaagccagcacccagctcaagaccaagcctctgcagtaactcatcctgctcaggattggagcattgggagcctggttccagtgccagaggctggagcccatgccatgtccgtttcttagttttgattgtgggattccccattgatccccattcctgctcaagcccctgctccacaagatgcaacctgatcttccccaatggccaagactggtgctgcagattcccaggaccactcatagtttgctaagagctaggattaagaatcgcatcttactgtggctacttagttctcaggaattgtgtgggacccagggcatgttgcctccttgaagcagttccttctcacagtctcttggatgctccctaaatcagattcaggatttgggtgggtcagggtgctctgctgtggcctggactgtatgattccccagtgggaaagtggactgcagaaagatactcactcactctctcttagggattcattgccagttcccagccggtcttgaccacgacaggctgtctgcttttcttctcattcccagattttggagtttcctttcactttttctgttgaaccctgtgttccctgttgggtaatgtattcaaagtgtgattgtctacataccactttggtttttctaagtggatgaggtgtgctggaaatgtttttagtcagctatcttggaaaacaaaggtcatcctcctgtcactttttgaacttctttggttactgtgttttctcatgactattattttcagccttctctgcttgctgttttttctctactcactaagtgttggccttcctgatagcccattcttgatctctctaattcaatactctgatattaggtgatgccttccatttctgtgatttaatagaactaaccatattcctacaactttcaatttttttttttttgagatggagtctcactctgtcactcaggctggagtgcagtggcacgatctcggctcactgcaatctctgcctcccgggttcaagcaattctcctgccttggcctcctgagtagctggaattacaggcgtgcgccaccacgtctggctaatttttgtatttttagtaagagacggggtttcaccatattcttcaggctggtcttgaactcctgaccttgtgatccgcccacctcggcctcccaaagtgctgggattataggcatgagccactgtgcctggccacaactttcaattttatatatccatcccagacttcacttaggagatcaagattcatctgtctaatgcccatttaacagcccctctttgagtctctctcagatgtctcggtttatacagatataaacttgaacccttcattgcacctctgtttcaaaaaagcaaaaacctcaccagtagaagaagctacaaaaatcctgttacactcccactgtttattagatattattattttagctgtccaggccagaatcctgggtgccattcttgattctttcctctcatttcttccacatacctagctctttgccatcccctatgagtactaatttcaaaatatatttcaaattttatccattttctcttaaccctattcttgcaatcttaatacaagttactatcgtctaatctctgagaccactatattatttatgagtacttaatactaggtattatacagaataacaaactgggcatgattttgtttttaggatttcaaattacttgtaaacagtaattttgaactcccagaattctgaagttacaagaataagaggtaaaaccctaaatataaagaaacatatcctaaactaaaaacagtgacttcactttcttccccaatagaactgtgtgatgcttgggtatccagaggaggtaagccagaatattgggaaacatttatttctagtttagattttggtttctagtaattctattgtttttttagttattcagaattttatggtgggaggaggaagaatagaaattttcatattatataaacatagctattttttgccagttatacaattttacataaggttaagaatgagaatatatatctctctccttctctatatgtatctctatatattacatatatagtaatgcatatgttaatgttctgaataaggaatttactatattgctaagtgaataggcctcatcccttggaatgaggaagttgagcattactgagaggaggttgtttttatgagggcagaccagatgctaaatgaggtacattgagctaggctggatgctcttcctgacagaggcacaaaattttcttacatttttaactaaataagtatgagctagtgtgagcaaagtaaatttctatgataaggtaactaacttgatagttactcaggtagtttttgggggtttgcacctttggggacattatttgtctgccatgaatagaggttgttgctggcatctagtgggtagatgccagagatgctgctaaatatcctacagtgcccaggatagccccctacaatggttatccagaccaaaaaggtccacagtggtggggttgagcaactctcttctagagtatttatttttcaacccactgctataatgtcctaagtatttttcaaaatttcatttaacaaataaacccttaataggagtaatggttataacgattccatgattttatttttgtgaaaatttaaatgaatggaagtatatttgtgtgtacttgcaataatttaggagaggaatgaatcaaggatgaataccaggtttctggcttgagcaactcaccaggaggatgttgttgacattgagatgagaaaaaaaaaattgtgggaaaagatcttcatttcagatgttatatttgtagaatttgaggtgcctgagagatatcaaggtgaagtcctgaagatcagaacataggcttttagacatatccttaatttgcaattcatcggtatgtaaatataatttggatctaggttggatgaaatcacccagtagagtatcttttttttttccatttacttttcagatttactgagtgaacataatttttcataaacatttgatctaaatcatttttgttgttgttgttgctggttgtttggtttttaatactgggaacacagagattcagtttgaaagataccctaaaatcttaagagtagtatacaccaatccctcccactctccacccacaatctagttggtttaagtgagcagaatgatccatttttccattttaggtgagcagatgtttatgaaagatcttagaactgtttgcctcatttatcaggaacatttacaagggaagaagccattaatcgtatttcaacttgtaaatagaagaagactaagactcaggttcatatcttatacttttaacaagaacttgttgaaagaaacattaacaatttcaaactaattttaagtttttcctcacaaaagcataaaaatggagatcttaacaggaaattcttaaaaggtaaaaacaactcctacttatactagtccttgggtagttaacatagaacaggttcttctttttgtttctttgaaaaggaatttttgggcccaagtctgttcctgcttagtatctgctccggccttcccccctctcgaagcggcctccttgacggcctccgcccctgggcaccctgcagcctgaccggctgtaagaatcatgcaggggagggctgcccgtttccatgggcagagggagcccacgatccggtctgcctacccggtctcgacccctcgagtagcggtcgctccggccgtaactgttgctggatctgtcgtggtcgccgctgtaggcgtcaggcaagctgccctggtactcctcgtagtggcctcctcctccgtagcggtcgctcaggccgtaactcttgatggaactgtcgcggcccccactgtgggcgtcaggcgaggggcctcggtactcctcgtagcggcctcctcctccgtagcggtggctccggccatgactgttgttggaactgttgaggccgcggcccccgccgtaggcattgggcgagcggccttggtattcctcgtagcagcctcctcttccgtaatggtcactccggccatagctgttgctgaaactgtcgcggcccctgctgtaggcttcggtgtagtggtccccgctgtgggcatcgggcgatcggcccctgctgtgggtgtcgtgcgagcggcctcggtactcttcgtagtggcctcctcctccatagcggtggctccggtcgtaactgttgctggaactgtcacggcccccactgtaggcgttgggtgagtggcctccgctgttggcatcgagagagtgacctcggttctcctcgtagcggcctcctcctctgcaggggtcgttccggctggaactgttgtggcccccgctgtaggcattgggtgagcggcctccgctgttggcatcgagcgagcggcctcggtactcctcgtagcggcctcctcctccgtagcggtggctccggctggaactgtcatggcccccactgtaggcgtcaggcaagcggccactgctgttggcatcgagtgagcgacctcctcctccatagtggtcgctctggctggaactgtcgtggccccggctgtaggtgtcaggcgagcggcctccgctgttggcatcaagcgagtggcctcggtactcctcgtagcggccgcctcctccatagcggttgctctggctggaactgtcgtggcccccactgtaggcatcaggcgagcggcctccactgttggcatcgagcaagcggcctcggtactcctcgtagcggcctcctcctccgtagcagttgctctggccagaactgtcgtggcccccactgtaggcatcaggcgagcggcctccactgttggcatcaagggagcggcctcggtactcctcgtagcggcctcctcctccgtagcggtggctccagctggaactgtcgtggcccccgctgtaggcattgggcgagcggcctccactgttggcatcgagggagcggcctcggtactcctcgtagcagcctcctcctccgtagcggttgctctggctggaactgtcgtggcccccactgtaggcgtcggcagagcagcccccactgtgggcgtcatgcgagcggcctcggtactcatagcggccttctcctccatagcggtggctctggccgtaactgttgctggaactgctgtggcccccactgtgggtgtcgggtgaacggcctccgctgttggcatccagagagtggcctcggttctcctcatagtggcctcctactccgtagcggtcgctccagctggaattgtcgtggcccccactgtaggcctcgggcgagcagcctccactgttggcatccagcgagcggccttggtactcctcataacggcctcctcctccgcagcagtcgctccagctggaactgtcatggcccccactgtaggcgtcgtcggaccggcccctgctgtgggcatcagtggagcggcccccgctgcgggcctcgtgtgagcggcctcggtactcctcatagcggccttctcctccatagtggtggctctggccgtaactgttgctggaactgttgcggcccccgctgtgggcgtcgggcgagcggcctctgtactcctcgtagcagccttcttctccgtagcggtcactccggctgtaaccgttactggaactgctgcggcccccactataggctttgggcgagtggtccctgctgtaggcgtctggcaagacgactggcaaggcctcggacgagcggccttcactgcaggcatcgggcgagttgccctggtactcctcgtagcggcatcctcctccataagatggcggtgtcccccacacaggggcagcgccgcatgggcctccgtagctcttgaggggctctcggtaggagcctttgctgggatgatctgtgtactcatggtcgcgacccctgtagccattttggttgccgtcgcctctcaagggacggtagtccgggacactggagtggccataatagcggcggctgtagtctctgagcgcagggacaaaatccccagggtcgcggcacgggggcagtggctcccggacccgcgggcctgagtagccatcttgcccccacacggccggggccttcccaggcattccactgccgccaatgcgagccaggcttgaccggggcacagccctcttgtggggtgggccggcccagcgccgtggctgcaagcctgagtagccatcttgccccgacacagtcggtgccttcccgcgcattccacagccaacgctgtgagccaggctcgacggcgtggccctcttgtggggtgggctggcccagtgccgcggtggcggcccgcgcttcctgggcatcggggccctgtagggccacaggtcgaaataccccgcgtagccgcggccgtcatcaggcctgccctgagaggggggtcgctgtgggctgctgccacccccacgggttctgtgtgagaaccttgagcgactgccgctgccgggggttggcgggacccatcggctgctcttgaatgccggtttgatggtctgggccaccatgatggccttaccatccaggtacttgccgttcatatctctggcggcagccttggcgtctgcagggctttcgaaggtgacgaacgcgaagcccctcgacttgttggtttttcggtctttcatcaggaacaccttgatgatgtggccatacttgccaaactcggctttgagggctttctcgtcggttttgaggttgaggcccccaatgaaaagcttctctgggcgatccgcttccatcatgtctccctgccgaatggtgggtcagaggaagtgggaagtgatgacgcggcagttcagtcgcggccttcgagcgctctcgtggagggcggctcctaccggttgggggggtggatgtctcaagaaggaaaagagtaccttacgtcatagttcttgggaacaccaacgtctatgatacaggtagaggaaatcctaggaatagaaaataagaagtagccagagaggtaggaagagatcccagaagtgtagtcttctaagccagaggaaaataatctttccagacatatggaatggttattgatatggtggttgttggttacattggtggatgtgagagtggatagaaaccaaattgcagtgggttaagaagtccatggtaagtaagaaatttagttgtgttgtgggtttatgtgagtttggctgtaaaagaagaggcagatggagggggttgtgggatcgtgggaggtatttttgtgtttgcttttaaagatcagagataattcttcgttggtattttaaaagacaaatagcatatttggaatttaggtatactgaagcatatcaaatacatctggttaataaacatgcgttctatgaggtttttttctttttttgagacagagtctcgctctgtcactcaggctggagtgcagtggcgtgatctcagctccctgcaacctccgcctcctgggttcaagcgattctcctgcctcagcctcctgagaagctgggattacaggggcccaccatcacatccggctaatttttgtgtttttagtagacacaggatttcgccatgttggccaggctggtctccaactcctgagctcaaaagatctgcctgctttggcctcccaaagtgctggtattacagatgtgagccaccgcgcccagccgtatgagtgtatttctaaatgatgttttttgccttcaaggtattgatggataatattgtatattttaaagtattttaagtagttgcttagattctaagtgattcagcaagtgtgaaaatagttcttttaattaccatagatataggtatatgtttaatactcactattttcttttcagatctttccagaaatcgttttacagaaattccttctgatgtctggttatttgcaccccttgaaacattaaatttatatcataattgcatcaaaaccattcctgaagccattaaaaatctgcagatgttaacataccttaacattaggtaaggaaacaatttaaaaataaattttggtttttattgttgttctaatccttttttagtcgcaaaggaatatgtttgatttggctgtgtagcttaaatttatctcaacagtatcttatttgtgttttttatatgttcacattattttgtaggcttttgtcttgttcttgagagcagagcttagcaaactttaacacacaggaattacccggggatctgttagaatgcagattctaatttcttaggtctgttatggggcctgcatttctaacaggccccttggcaatgctcatgcctacctgctggtccttagacctcagtttgagtagcaaggctttagaccataaatatttcctgaaattatagcaccacgatacagattttatatgcatccttagatatgtgaaacaaacagtgcttgagttattttttctcacttttgtgacttcttgcttctacttcaaggatggttagagtggggtgagaatgttgaaaggtttggaagtggatgacagttcatgtttatacttagtaagtgcttaccatgtgccaggcagtcagtgttccaaacgctttacccatattaccttatctagttttcatgacagcattttgagataggtaccattgttatccctgcattacagatgaggaaattgggttaagctatttgtccaaattcatagatatattcagcaagtggtagagccaagattaaaatcaaagcagtctggctatagagctctcattcatacatagcttttaccctatatatgtaaaagaatgaacactcagtaagtataagaaaaaaactttccctgccaaatcagtaacattgaatgaaaattgatatattgtgacttaattttagaatttttttctttttttattcagttggaagggataatctcctcattaaccaagttacttgtctaaattcccatatagagaagtagtaaatataattaatatacataaatgataatgttcccttctcactgtgatatatcagttcttttgtatgactcccccagtggtgttacctgacagtacaagctattttaactgaaaccactttacaccttaaaatgtgtgagagaagtttcctggctgggtgcggtggctcacgcctgtaatcccagcactttgggaggccaaggcgggtggatcacgaggttaggagatcgagaccatcctggctaacatggtgaaaccctgtctctactaaaattacaaaaaattagccaggcgtggtggtgggcgcctgtagtcccagctactggggaggctgaggcaggagaatgatgtgaacctgggaggcggagcttgcagtgagccgagatcgcgccactgcactccagcctgggtgacagagtaagactctgtctcaaaaaaaaaaaaaaaaaaaaaaagtgtgagggaagtttccttccaaagatatcaatcatttgggttgctcctttctctaagtaggtataaatctccttggcctggcttaggagaggtttgaggaaagtgaggtatttttaagttttgtctttgtttctgtttcattttgttcttttgcggaaaaagtgattcgccaaaaactgaattacacttctctattaacacatatggtaatcttagttttactaaaactttctctgattctatcctgtcacgatctgtaaaagtcaactttgatctttttttacagtcacaaaaatttttgagcaaactatattgaaataacatttgttctagtgactgaattcttctctaaggcatgtagtaaaatagtgacaattaataatttatttgccggtattaagaaaccagattctggtgaaagatgattgtgttaactcaatgaatatgcatttttttttttttttttagacggagtcttgctctgtctcccagggtggagtggcaccatcttggctcactgcaacctccgcctcccaaattcaaatgtttcacctgcctcagcctcccaagtagttggaagtataggcgcctgtcaccaggcccgactaatttttagtagagacagtgtttcaccacgttggccaggctggtctcaaactcctgacctcaaatgatttgcccgcctcggcctctcaaaagtgctgggattacaggcgtgagccattgtgaccggcctgaatatgctttttaagggaagaaaataaattgatttttaagctatttttggcctgaagatgtattagaatgagtttgccattatttcttccatgtatttatttattttggtgaaaatctcttaataaacttgtaaaataatttttcaactcttctctcttcctatatactacccccctttttcagtagaatcctgtagaaagatccttgtgtgccctggtatgaagggacccagactgaccatttttccaaggagcctgcttcatcctgaaagtatgaaggattatgacaggaccctagcacatttgacattccagcagtctggccattattgcttgttgaggggcattgccatttttttgtttgtttgtttgtgccgtgttattaaagccagtctagtatttctggatgtcctttgccagagaaaagatggggaggagggtctttcaagtcccccttgagtaacactggacttttgttgctgtgtatgttacacgaaatgctaggtataggtctataaatgacactttgaaaaacaggaaaaataatagcttatcgcttaccagtgcttgttagtatgtaaatggaatggaaaaatatacattttgttagtggttcctttgggtcagtcagtctgttttggcatataaatttgaccatagtactttgagggcaaagaccccagagccagattgcctgagtttgaatcctgcctctcccatttaacagctgtgtgactttgagcagtttacttaaactctttgtgactatttcttcatctgcaaaatggggatcactgtgagagttaattcacatgacctgctgcaaaatgaggatcactgtgagagttaattcacatgagctgccctgaacatggcctggcaatagtaggcactcagtaaatgttagttattatatttaaatgtatctacagagataagaatgttttatcaactttgagctgagataaaggtgctaataggctgttaaaccttaaaagggaatgggttagggttactacatgtttttgaagatatagtcctattcactcttttataaacttaaacatagtgcatgcacatttatccctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacactttttagactgaaataaatggtaaaaggccattatatgcaattgattgtagaaatacagaataatttaaattaattaccttggacataacattttaggtattaaaggacattgaattctgagagaaacatattcagagcctcgaagctttcagctatttttcatatcttctggttacctccactttacgcagtataccatgcttcatgtttttcttttattttgaatgatgctttcctaataaacaggtatttttaaagttttttttttgtgatagagtctcgctctgttgcccagactggtgtgtagtgacatgatcttggttcactgcaacctccgcctcccaggttcaggctattctcgtgctcagcctcccaagtcgttgggattacagccatgcgccaccacacccaacttatttttgcatttttcgtagagatggggtttcactgtgttgcccaggctggtcttgaactcctggcctcaagtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttccttttagttaaagtctcacttaatgttgtactaaaaaatgaacagagattccagatatgatctaacaagttcataataaaaggtaccattattttgtttgacttgaacactattaatgtttttccagattttataaaggttataatttaagattttatgtctccgtaatttatttgtttttaatttagtttttggccctacgtttttaattacattacatgatgtaatttttagataaatgaaatgtaaaaaataattaggagttttatattaattctagtacagttgtccctctatgggggattggttccaggattcaccccataccaaaatccacgaatgctcaagtctcttatatacaatagtaatatttacatataacctaaatacattctcccatatactttaaatcatttctagattacttataatacctaatacagtgtaaatgctgtgtgagtagttgttacgttgtattatttaaggagtaatgacaagaaaaaaaagttaatatatgttcagtacaggcacaaccatgctttttttttcctgaatatttttgatttgtatttggttgaattcatggatgcagaacccatggatacagaggaccaactgttttttaatttatgtagaaaattctaaaatgtttaacactattattttactaggtactgtaaaattattatgctttaaactcttgaaatcagtaacagtagatgggtagatagcattaggagggctaattgacagttgtaaatcacatattgaattggtggatattccctgtcattggaatattttctcttgatacttttccacatcatgtgataatcaactgcaatgaaattctgtcattagaaacctaggaaatactctctggcttccaatcctttgcagactattttgtagagcacccactggagtgggttcatttcctatgcctgggtttatttctcttgggaaatgacagctatctctcaaatttctatggattttccatatggaaatcataagtatcaaatacctttagaaagaagcaataatgtttaaataacattttcacaaacttctattatccatcgtttgaatagtagtctattctgaacatagcagctaaggtgatcctgtcaaaatataagtcagatcatgtcaatcccatgttcaaaagtttctggatcctgcccacatctctcagaataaaagctaaagtcatatccctccctctattctactctctcccttgcccatttccctctagttacactggattccttgctgttctttgtacctgtcaggtgcgctctgcctgagcgccttcacttttattgttccttctgtctggaatattcctttcttatatattagtatggttcaccttttagctctgacagtactgctcaatatcaccttctctatgagataaagtagtatccctccccactattgcgagcatagccattttcctaccctgttatcttttttaaatagcacttatcaccttctagcatattatataatttactccccttgctagcatgtaaactccatgaggagctatgacagcaggaaattttgttttgccccttgataaatccccagtccctggaacagtacctagcaaatgttaatagtattcaacaaatatttattgttgaatgaagatgccttagatattgtttgaaagaggtatgtaggatatattttcctaatcatctatagcattattatattcttccctacatggttttaatattattttgaaaactgaatgtatgtactattctcctccctccaagctattatcattttcactaaaagttggaaattgggggcagttgcattagaatatgaatttcatttgaagtgtgtctggaatgattactgtctgagaccatgttgtagatttctcttttttttgttgttgatgttattataagaaagaggggagagagcacagttaacttaaactgttcttttttctgttttttttaattatgataataaataaaaacctcaatttgttattatggaaacttgatatcgtttgcctttaaattggggcttggattttaaccacagagatttcctgagagacaccttagataacctgagagatttccaactcagatctcttagaatgtctttgagctatgagatgagtcacaagtgttggggcttgtaacttctcattttgtatccctttggagaaagagatttagttaaatcaatctttatcatagtctgtttcgccagtgcacatttataaatccttgactttcttagcttctgcccagccaagtatctcgagacaactactgtaattgacagattacacaatgtttgagagttgttagtcttttactttacctccacgtgaagagtgctggatcattcttacttctggttttggctggtatgagttggcctttagttgagattttcgagaggttgtagttactaagatataacctcaaatttttgtatgggaagtttctatttactgtactaggtcggcttcatgatgtcgtataaatagaaatctgccagataatccatctttagagcaatgacattagaggataacttttgctagctattaaccatgtgctttaatttaaaaattagaatatatatatataatatatgtatttctcagttagcttgttataattctgttttattgttctccttaggatattagctgcaatgagattcaagtccttccccaacaaatgggaaaattacattcacttagagagctaaatataagaagaaataatcttcatgttttgccagatggtaagatgttcactgtttttactcacatgaataagagagtaactatgtaaaatttaattaattatttttcatttctgaccagaattaggagaccttcccttagtcaagctggatttctcttgtaataaagtgaccgaaattccagtttgttacagaaagctgcatcatttacaagtaataattttggataacaatccattgcaagtaccaccagcacaggtttgtaataaaaatattataatgtttcttctcatttttattcataattttatctgtttatgactggtaaatcaaaaagcacctaaatcaagagccaatttgttgttcaagcactgttgtctaaagtttttctgagcattgccttttgcactttggtaggagttttagcttaggctctaggatagcatttggaaaacccagataataactttctgcttgtgaactgataattctggttgttagttatttacaaaagtgactctgaagtctctctacctatttcccactcaggtatatatctacttgggatttgttgtgggattgattggagtacattcttggcactgagagatggaattataacagaaagaacaaaatacaagtggaaaatattaattatgacttttagtttagtgaggattaaatccatgtggaatcctcttaaatgatagttaaggaataaactatgatataatcccctatggacaaagtatgaaagagaagaaagaggacagtggggaagagatgtcaatagaatttctgaaaatggaaaatagaatagtagaaacaagtacctttacttagattgcccaaaattatttggctgaggagcaagtagcagtgaaatggtactttatgctgtgtgccctggcagagggtttgcagacatccagaagaaaggtcttctttttcttcctacaaaagtacattccactcattctaaaggggttaccttttctaattcaaataaagactggctagagtcctggtggtagcaaccttagcagaatgaagaaagctgaaacttgtgcctgctatgggagaaggcaatcagattcaagttgatttacagcgtcaaacctgggaatggcttgagtattggaggaaacatgtaactctgaatatagggattaagtactgaaaacatgatggtttgtggaatgtctaaggcagtgctgtccagtagaactttctgaatgatggaaatgttttataatcgacactggtccaatactgtaaccacttgtttatgtggctgttgaatgcttggaatatagctagtgcaactaaggaaccaaattttaaattttattttaatttgatttatttaaatttaaattgctgcatgtgactggtagctcccatattaaacaccacggctctaagatttacaccctcagattcttgccctcagccccacagccacagaccattccttacttgcatcagcagaagtccggaatttattctaaggagtaggtagatccttaggttttctccgttagctcagtggccagatgatgactcacttcttgcctcagcagaagactggtgtttactccttagagaagcaccatcccatttgtacttgctgtggtgatgagcatgttctgtatctgcattgtccaatacggtagccatagtggctactgagtacttgaaagtgtatagtgtgacaaaagaactgaatttttattttatttagatttgattaatttacatttaaatacacatgtagaacacaaaaccaaacaccacatgttctcactcataagtgggagttgaacaatgagaacacatggacacagggaggggaatgtcacaaactggggcctgtgggggtgtggggggcaaggggagggagagcattgggacaaatacctaatacatgcggggttgaaaacctagatgatgggttgataggtgcagcaaaccaccatggcacatgtatacctgtgtaacaaacctgcacattttgcacatgtatcccagaacttaaagtaaaataaataaatagacacatgtggctagtggtaccctattggacagtgaagctataaagggattgaaacagagtcaggggctccaggtacagcttatatagcaagagcgagaccgcatactgaaaacagtgaatggttgcatactgaatgttgagacgctccagtttggctcccagaatgcttgcaacctgtcttacatatttcaggcagaattggtggatttcttccttagtaaactgcagcaggagaagagacctatctatatactgaatttttggagtcacctgatgaaatggctagtctgtgtctgatcaccagatagatggaagctcaccatcaggaaacttccccatgcacacagagcttccagtttgttttttattatcccttttggaaattaacagacaggtcggatggtagctcatgcctataatcccagtactttggaactttggtagactgaagtgggaggattgttagaacccagtaggttgaggctgctgtgagccctgatcacaccattgtaccattgtactacagcctagacagcagagtgagactctgtctttaaaaaaaaaaaaaaaaaaaaaaaaaaaggctgggtgcggtggctcacacttgtaattgcagcactttgggaggctgaggcagatggatcgcctgagctcaggagtttgagaccaccctgggcaatatggtgaaaccccgtctctactaaagtacaaaaaattagctgggtgtggtggcacgcgcctgtagtctcagctactggggaggctgaggcacgagaatcgcttgatccttggaggaggaggttgcagtgagccaagatcgtgccactgcactccagcttgggctacagagtgagactctgtctcaaaaaaaaaaaaagaaaaaaaaagaaaaaagaaaatgaacagccagccaagaatcattagacattgcaagagtaatctctaacatgaaagacagagaccaaaacaccaaaggctttcattgaaacgaaagggagcacatttattttttgtgtgtgtgtggatatccagaaatatttgtaaaccatatatctgatgaggggttaatagccaaaatacaaaaaggattcatataactcaatagcaaaaaaaaaaaaaaattgaaaaataggcaaaggacttgaatagacattttttcaaacaagacatacaaatggccaacagctatatgaaaagatattcagcattcctaatcatcagggaaatgtaaatcacaaccacaatgagatatcacttcacacttgttaggatgcctgttatcaaaaagaaaagataaccagtgctggcaaggatatggagaaaagggaaccattgtacactattgatgggaatgtaaaatggtacagccattatggaaaacagtatagtgcttcctcaaaaaattaaaagtagagctaccatataatattacagtcctacctctgggtatacatctgtaagagatagaaaaataaaccaaactattttttctattttaattctcaatacagaatacttcacttctggtcaccaaaatgcgtcagatttcttcccaccaccaagcagttctccagcagacactgactgggtatcctataattcaattcaattctgacactacctggagttaacatcagatcctacaggttaagagctcagtcccacagactgctcacctatacttctgactgaccaactataagttaaggttcccatgaccccctcctcaggttcagttaatttactagagtggttcacagaacttagtgaaacactttacttactattgctaatttattacaaaggatacaaatgaatagccagatggaagagaaggataggacaaggcatatgagaaggggtgctaactgaaggggtggagaggggatgttccctttcctccccatcataagggtcacggctgatacccctataacaaaaaacaagtaaacaagataaaaggataacaactttatttgatcatagttttacgtgacactggagccttcagaataaggacccaaggatatagagaaagttagctgactttatgcttcgattcaattcagactgggacagcagtgtagaaatgtgattggacaaaaaaagcatgagctaatggtaatagatggagtgggaaaacctagcaaggccttttcttggtgtctctgttgtagcgtttgttccttctgggtgtagggtaatacttctctggaatgagggttttaatttgtttatggccagtggttacacagaaaggtaggggaaggttagattaggctttatggctggctttggaaaaaaggggttctagtgcctatgactggccttggggacgataaattcttgtttccatgacttgcctctagtgagaatgaggaggtgagagacaggggaggggcgtctggagaaggtcagagaaaaactttgcttctgaggctttcattttggggtatcattttctgaacctcaatgaagcttttgtgccctctgtgggcacgccaccttccaggcacctccacgtgtttagcaatttgtaagctttccgaaccctgtccttttggtttttatggaggcttcgttgtggaggcacaattggttacatcattggccattggtgatcacctcaactttcagcccttctctggttcctggaggtgagggaggtaggattgaaagtttcaaccgcctaatcccatggttggttttcctggcaatcagtcccttatcctgtggctatccaggagctcccagccaccagtcattcattagcatgcaaagggatacttaccacttaagagatcgtgtaagagttttaggagctgtgtataggaaatgggagcaaaaccaagtatacattccttacaaattacaatatccgaaggaaatgaaatcaccatcttaaagaaataatctgcactcccatgttcattgcaacattattcactacagtcaagatatggaaacaacctgtatgtccatcaacagatgaatggataaagaaaatatagtgtgtgtgtgtgtgtgggggggggggtgtgtttgtgtgtaatgaaatattattcagccttagaaaaagaaggaaatcctgtcatttgcaacaacatggatgaaacttaaggacattatactaattgaaataagcctgacacagaaagataaatgctgtgtgatctcacgtatatgtggaaccttaaaaaaaaaaagttgaactcctggtgacagagagtagaatggtggttaccaggggctggggggtgtggataaaggggagattttaaacggtaccatccttcagttataagatgaataagtactgaggacctaatgtatatcatgctgataatagttaataatattgtatttacttgaaatttgttaagagagttgaactgaagtgttctcactacacacacaaacaaggtaactacatgaggtgatgggcatgttaattagcttgactgtggtaatcatttcacaatgtataatacagttgatccttgaacaacatgagggttaggggcatcgaaccctgcatactgtaaaaaatccatgtataactttggaatcacaaaaaacttagctgctaatagcctactgttgactggaagccttatcaataacaaacagttgactaacacatattttatatgttatatgttatttactgtattcttacaatcaagtaagctacagaaaagaaaatgttattaagaaaatcataaggaagagaaaatatatttaccattcactaagtggaagttgatcatcataaagatcttcatccccatggtcttcacattgaacagggctgaagaggaggaagaggaggggttggtctagctgtctcaggagtggcagaggtggaagaaaatccatgtataatggacctgcacagttcaaacttgtgttgttcaagggtcaactgtatatcaaagcatcacgttgtacaccttaaatttgggagttcagtcagggtggtgggaaaaattatagaagaaaagttatgaagatagttataggaaatagacacaaaccttcttggaaggctgggggggttgcatagcttcagtaaaaagttcagctgaagtcagcctaatcctcttaccttgagttaatagtttaaagtaggtacaaaggaatgtaagggagtttatctaaatagcttgtttactcatgtggccctaagcccaaccttttatcatctgtgagtgcatgattgctctctactcgaggggttggcagtgttaattaccttctagcggtgtttactcgagacctttgtaatttaatcagtactaaataaatgcgaacttccccggcttatcgaggcagatgctgcagactcaggcagcagagccccttagccagactgacaggcaaagtatctgtgtcagtgtacgtctttcatccgtcattgggtcagggtcagcgggatggacatggcacttaaatataaaaaaattttatttgtaactcatactttaataaagctcgaagaaaaaataaagaggaaaaatggagcatattcataggagtgctaatcagcatggctttctagcagcagttgtggaaactggcagatgttggaatgataccttcgaggactaagggagtatttctaacattctacattcaaactgtcatcaaatgtgaggtagaaaaaggtttcaaacatgcaagatcttagaaatttttactcccatgtaccctttcttaggatgctagcagagggtgtactataccaaagtgagggagtaaactaaaaaaaggggaattcttcttgtctgagattgacagatatgcataggcctagtaagcagccagtcagtagtttggagtacaggagttgtctccaaaaaaaaaaaaaaaaaaatagaaagtaagagatgatttgatacgtttgtccacatggagagatgttttatacttctgtcagagtcaagaatgaatttataataggcatatagaaaatttttcaaaagaaaaaatggggccattaattactttaggaaaaacaaaaacttacaggagaaaggaaatgtaatcatattactctgtagagtttatctgtgaatattttcttggtcataataatataaacactagattttgatttagtgaaaaactgtgacatagttataatagcagagatttatatagtatttgctgtgttctagacactgttgaaaatgctttacatatattaactcatttaattcttatgttaaccctgtaaaacaagtactgtcattatcctcattttacatgtaagaaaacagaggcatagaagttaaatgacttgttcaaggtcacattgctagcatgggttagagccaggattcaacctaaggcagtgtgactgcagagtccatgctctttaaccactatgttatacttctgaagagagaagtatgtttatgtgaattgataggaagcggggaggctgggatggtggtggtggtgtgggtaatgtaagaaatccaagtcctcatcttccttagtgatactccaataaatctaccattggaaaatttaaaacaaatagcagtagaagcatgttattaataaatatgagggcaaatagaaattaaactaaaagagtttaaagtgggaatttgatcttagagattgaaataattagaatgggctgggcacggtggttcatgcctgtaatcccagcactttgtgaggccgaggtgggaggatcacttgaacccaggagttcgagaacagcctgggcaacatggtgggaccctgtctctgcaaaatataagaaagattagccgggcatggtggtgtgtgcctgtaatttcatcccagctaatctgggaggatcacttgagcccaggatgtcgagggtgcagtgagccatgtttgtgccactgcactccagcctgggcgacagaatgagacgctgttttccaaaaacaagcaaaaaaaaaacaaaaaaacaaaaaaaaggagaagtagaattgaggattatgtcttgtcagctttgtaattatttttaaatttaaaaactgtgtacatgaagtactatgataaaaagttaaaatttacaagagagtgatttaccagcacttaatttggtaattaagataaatttttgtttagtttggacgtataatagaatactacctcacattttaattttagcacattttagttgatagtatttaatattaataatttataattaatagaaaaatcaatgatatttacaacatttaattggcaatatatttatattctaatagctcaaaagttttaattttccttttaaatgaaatttttcagtggtcaagtcagacctagtatctgttagaattatctaagaaacattcttcctttggacctggaatgataattgctttttaatgttgttgtcttactgttttctttgctgatttttttgcatgtgaggtaagcttatgtgagcccataaaatgttacattttttattagaattttgagaaatatttatttgatgtcacttagtgactgtaattaaccttgataaagctgacttacagttttcttacctctcattttctattgtttttatacagagtatctttgctcacatagtattttattcctcattattcattttctctatggccaacgaaagtaatttcttaggatattattctagttgaattgaccagtgttttcttttattatttcagtctcaccagcctaatatcgtacctttcaaaaaattcatttttcctatatttatattttttatgttagccttctccaggttttatgccaaacatcttagtggttctgatgagattactttaaagaatcacatagattatttgttcttttcttaccattccaatgaatatatatttttcattttttcaaataaaggccacttttatgagttgtaaacttcatattgtttaatagtttgtacattctgcttttgacaagaaaactctagtgaaatatagaaaaattaacttttttcaataagaacagagatggcaatagaattttagttggtatcagtgttgtcagatttttccacctggtgtcagaagtacaaattatttaaatatgcaaagtatcaatcaagattgtgatgtctcaatgtaatttgagactattgaatggtttaaaatgatagatgtcatttatatttggaactatataattaaatctttattttttattgacagatatgtttaaagggtaaggtgcacatatttaagtacttaaatattcaagcatgttgcagaatggataagaaaccagattccctggatcttccatcattgagtaaacgaatgccctcacagcctctcacagacaggtaatgtaacattcttacagtttcatttgatgattgctgtcttctctttttatgaaatatacttattaatcttgagtgttccgaatatatttaggctgattggtccagcactaaaataaataattggctgaagctacatatcaccatcatagaatgaagttctaggatactagaatatttttgacattttctcaatcattaaagttttagtagtaaaaatgtaaatgtttgacattatattacggaaacactaatttctcagcatgtgacaactgttaatttattttgtgatcactgtattgtacatttgtaacaacaagtagaatttgactttgaactgaggttggtggaagagcaagacatttggggagtaccttttccctttcatcatagtctttatgtctggatcaaagatgatatatcataatgacatataatgatatatcatctttgatgaacatctttgatgttctttatgatttcagtgttttgatcctcatgagattttgagatagtagattgaacattctgtttttaattcatcctttcaagatgtagattggtctgaaagattttatgaaagtataaatccatgtaatagtttagaaaataacctagaatggggtgagactacagaaagctagaccatgcccttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaaaaatataatgtgagccacatatataatttttaattttttgttacccattttgaaaaaagtaaaaagaaatacatgttatttgagtatatccaaaatattatcatttcaacatgtaattaatgtgaaaacttggtgagatattttatatgcttatttaatattaaatctttgaaatctggtatgtactttatgtgtatagtgtgtctcgatttggaatggctgtatatggctactggctgcttaccgtattggacagtgcaggtctatagagtgggttgtcagttgtattaatttctcactcacagcctgtattgaactacttagaaaattcttgtatgtgctttccactttcatactcaggctcttggctgtatggttcttactacctagaatgcccttccatgccttgtctgttttgtaaactctttattatacatagataggcactacagtacttacatataatagcttttggagtcagacataatatggctttgaagcccttttatgactcttaataactgtatgtccttgtgtattaatgtctctggtcctcagttttctcatatgtaaaaaagaaaataattacacaggtgctgtcaggattaaatgaagcaatgtatgtagagcacttagtgcaatgccttacccataacatttcctcaacaaatagcttattatcatcattgtcatttactacaaatacatggagtattttgtgcagtgcagtcagatgaattttggctctaatcatggtttaactacttaatttctctgtggccttgtgtaagttatttaacttctctgagcctgtttccatacctaaaatgttaaccatacccacttctacagttgtgagaattaaatgtgtgcctagcaattagttcaataaatgataaacagcaaatgttataatttttccccttgggacgttaacttttgtaagctttatttttttttgtaaaaagataataattataacttcaagactgtaagaattatgtctaaaatatgaggtgcatctaacacagtacataacacagtatagacactcaatgaatgctaacagttattgcctcttcatccacaagactaagctcaaatgccacattcttgagtgatgcctttcctaactttaccgaggagaattagttgaccttttttttttttctcatagcactttgtatttacctttgtcatagtcttcaaaacatttaaacacattcatttttcctctaggctgagagctagctctttggaggcaagttttaaaaatgtattttctcttaagcattcagcatagtacctgatacttggtaggtgattccctaaatgtattcatatacttctgaaaagtacaaaaaaaagtttttttttgttgttgttattgttttttttttttttttttttttttttttagcatgaaactggttttaggagcggaattaaaacatagtgattaccaccagggactttggtgctagataattgagggatcaaatttggactgctggctgcaagttgcgtatccttggataaattgcttaatccattccagtcaaagttttatcatatataaaatgagaaaacaccatcaatttgctacagtttttcacaataaatatgtaatgttttgtcttttaaacatttagcacagttcctcatacataataagtggtcattgtagactgtgtggtaaaattgcaaattaagtgaaaaatactttgcttcctgggtggcatattttgtaaatcagaaatttgcaaggacaaagtgaatttgaaagtattaaagtgcatattcaatactttgtagctttcatttttacatcctctctttattagatgggcattatttatataaataaaacatttttagagccaatgaagagtaaagcatataaattgaagttaaaagatgtttcgaagctctgtgatgaaatttgacaaaccaatgggaaaaacaggtcttccatcaagataatgttctaacaaggcagcctgattttctgaatctctgaggagaaataataggttattgttgacaattgacactatagagtacacgaagggaacaatattgcatgagtggcatgaataaaatgttttgtaggaagagttctgatatttttctcctcatgtccctaattaaggatcttagacatcaaaagtatatattctgtattatctagggaaattttaggtcaaatgtgcattatctatttaagaagaaaatcctaactgctcttaggatttctatttccatagtatggaagatttttatccaaataaaaatcatggccctgactctggaattggaagtgataatggagagaaacgattatccacaacagaagtgagtattttctattgctgatccattctgttttacaattttattagagcattgaaatagagacccttgtgcatacttgagtttattttgcttgaaaatatgatcattatattttatgactaaaactgaaaaaaagggcatgctgatttttaaagctgagcagtaaaccttatgttaattttgggtttgaaaactggagatgtaaagcagacattctgtaattcatatgtaaaattgaagtaacataatccatatcgtaagtttaaaatgcctcatttgtactttttgcttattccttttagccatcagatgatgacacagtcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataa

SEQ ID NO: 1200 - DNA, 3140 bp, mus musculus
aatcaacgagcgcccgcgcccccatccccatcccgtggagtggccggcgacaagatggcagcagcgtgtcggagcgtgaaggtagaaggttctttgcctctgttgcttgccttcctttacgggccgggacagcgcggccgtggaactaggagaaagagatcggtttcgagggaaagggtcatgcttatgtaggcctggtattgtggccgttgggctcaagaggtgaaagtcagcactccgcggcgcatctgtctgtctgtctgtctgtctatctatctatctatcaatcatctatctatctatcgtcacgggacgggctgtctggggatgagatcccttctgcccccgaggtcccaacgctgaggagaagcagcacacctagtttacccgcaggggtgaccacgacctctcccctccccccttctcctcagaagcctggagaacaggcaggcgacagcgtggggatggtctgggcaatgtaacagctgaccctgaccatgtcccttttgacagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtaagtggggtcacctctcctctcccagggtgtgcatgaggtcaccaacaccggcctgggaacctgtgggggtccctcccataagggtctcctctatgggggcggtagacccatctccttgtctcttttggcctgagccttcaagcactgtgggaccacctgtgataaggattctctaaagctgggattcacaacaatgaggatggggattggacgtaacaatctcctggaggagttatgtatggtttgaaaatgcattttgtgccttgtaattttatatttacaaagtcaaaaaacttgttttcatgaaacaaactacagaaagtgaaacttgatgaaatcatcttagcaggtaaggatacaaaaaagctagtttatcttcctatcaataattctcacaagagggttattttttatttttatttttgagatggagtctcgctctgttgcccaggctggagtgcagtggcacaatctcagctccttgcaacctccatcttctgggttcaagcgattttcctgcctcaacctcccaagtagctgggattacaggcacctgccaccacgcccagctaatttttttttttgtatttttagaagagatggggtttcaccatgttggccgggctggtcttgaactcctgatctcacgtgatccgcccgcctcggcctcccaaagtgctgggattacaggtgtgagccactgcacccagcctcacaacagggttgcattagtgctctgatccacagcaattaagaatcttcaggagcatgtgaatttatcaagaaggtattgatttgaaaaatgttttgcaacactgctctatattacctaatattttcacctttgacctactctctcaatttttttttttgggacagagtctcactgttgcccaggctgcagtgcaatggcacgatctcagctcactgcaacctctgcctcccgggttcaagcgattcttctgcctcagccttccaagtagctgggattacaggcatgtgtcactatgccggctaattttgtatttttagtagagacgggttttcaccacgttggccaggctggtctcaaactcctgatcttaagtgatccaccagcctcggcctcccaaagtgctgagattacaggcatgagccaccgcacccagcctatctctcaagttttacaacctttctcttggcctctcccttctcacaaatctcttctcacccaaggactgggcatgccctgccctgccctccctcaggtttagtgggaagagtgggtgctgggagatgaataccttctccacttctctctttgaaggtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtaaggccttggaagttctccagggatagtggtagtaagaagtatctggctgtggaggaccccaaagtttttaggggacaaaggcttcttctgcctcaggtcctatagcatgtctccatctgtcctacaggtgaatctcatgggcaccttcaatgtgatccgcctggtggctggtgagatgggccagaatgaaccagaccagggaggccaacgtggggtcatcatcaacactgccagtgtggctgccttcgagggtcaggtgtgtgggcaggggtaagacttatgcctcctaagtgacttgttggggccctcccacctatgacttctactctttctccaggttggacaagctgcatactctgcttccaaggggggaatagtgggcatgacactgcccattgctcgggatctggctcccataggtatccgggtgatgaccattgccccaggtagacatatcccctctctccatcatacctgggattgggtgggatccatggacagttgagaggggaaggtatccaccacctaagcagcagcagccttttatctttgggccccagagaagcaccaagaagtagggctaaagtaaggaagaaccaggtaatcatgaaagcaagggtgagtctctgaatttggctatattgtttaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacaga

SEQ ID NO: 1201 - DNA, 163120 bp, mus musculus; identical to SEQ ID NO: 193

SEQ ID NO: 1202 - DNA, 146737 bp, mus musculus; identical to SEQ ID NO: 194

SEQ ID NO: 1203 - DNA, 55842 bp, mus musculus
cagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggtttggggtaatctgctttgaaaccctagtatcaccacttattagctgcatcaccctgggccttgcttttctcttccatagaatgcagattaataattctatctcagtagatactcgggtggatgaaatatcttgtgtatgtggcagaggctgccacttgtatcttagttcaacttcccttttctactcagtttggaactatttttctggaccactgctgataaaattagtgtttttctgtccttaaaacaccttccagatgtggtaaaacgaaacttaggaagactgaattagtttgtccaaaggctgaggctagaacacaggttttatttgcttctgatttaacattgtttccaccagacttcatcacttctgaaagaaagggctactagcctgccttttctctcattctttgggcaacttaaccagaatgatataaccaacaggacttttggacaacagaaacaagtgataggtaaatgacctcatcccattcttcagagttatggggaagcccttgagagttgttgacctttggtgactgctggggacacagagaatgggtggggagcaatgtcttcaggtaagcctggagggcagacaggcagaaaacataggaagagtagaaataataacctcaaaagtaaaaatgacaggtgcatctatgtagtccaccctcaagaccaacttacttaatggctgtaccttcagagccctcaggagctatacatccctcttgtttagacttttcagggcacattggaaattgggaaaaaaataaccatgtagcagactaccatcaccactctcattgttctaatacatgcatttctgaggtggggttctcattggctaagtgaattccaataaccaaagtagcaaacagagcctagtcatttttgatcttgccagattgtctgtgcctggtgcggtgggggcagtatatgatcttctaagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatgtccctttcccctcttcctcattttctcatttaattagatgccaatggctgttgtattttttcccctttgtatctggtatctgtttctttattattattctaactgccaccaccttaatttaggcgagacgtgcaaacaattagcctacagaccaactaaagctcacacgtgttttgttttccctaaaatttaaaaactttcaactaaaacatgcattttcaattggtaatgcattccgcctggctcaaaattcagtatttactaaagggtgcatggtgaaaaaagtctccctcctattcctgttctctagccacccattttgcctcgctggaggcaactaatgttatctatttattaggaatctctccagggatatttagtgtatatcaagcaatgagtatgtttgtgtgtgtgtgtgtgtgtgtgtgtgtgtgtgaataacattgtagtattgggctcatttgtttactcaaagataatgtgaaatcatgtttggttttctatagatagatagatggatatatatatatatatatatatggttcagtatcttctgattattcaaaagaaactggaattctaggaatttaagtgaaatctgattttgaaatactggttatcaatcaacttttaaaagtgtgggactaggcaacttgacatactgacatgaactgaattgtgacccccccatcccccccaaaaaaattcatacattgaagacctaatacctaagcttgtgactgtatttggagatagggcctttaggaaagaaattaaggttagatgagctcatattatatataatacatatataatattagtatatatgtaagtaccacaacaactatattttctcactgcttacttcactttcatgccttcttctaagtgtttacaaaattaacacacttattcttcactgcaaccttatgaggtagtttctattatatatatatgtgtgtgtgtgtgtgtgtttgtgtgtgtgtgtgtatatatatatccccttcaccttttatacacagatagtaacacattctgcatattgttctctacaacttgcttgtctacttaaaaatatactttggagatattttcatatatgcacattttttaaatgcctcattcttttttatgactgcataggtttttactatatgcatgagccacaaatttttaaacagttttctgttgattgatctttaagttatttccaaacttttgcagtgttatttgtaataacaataaaaacttttgtaagcagtgcattagagagctcaggctgccataacaaaataccattgactgagtggcttaaacaacagaaatgtattttctcacagttctggaggctgggagtccatgatcagggtgccaacatggtcagattttcatgaggactctctttctgacctgtagaaggccaccttttcactttgtactcatgtgatctttgtacaaatgggaggagaaagagtgaattctctctggtgtgtcttcttagaaagacactaatcctatcagatcagaacctcacctttatgagctcatttaaccttaatttctttcctaaaggccctatcttcaaatatagtcactaggttaggtcttctacctattaatttttttttggagagtggacacaacacaagtcagttcatagcagtgtgtcaaattgcctagtcccacacttttaaaagttggttgattgccaatatttcaaaatcagatttcccttaaaattctagaattctaggccgggcgcagtggctcatgcctgtaatcccaggactttgggaggccaaagcaggaggatcacctgtcagcagttcgaaaccagcttgaccaacatggtaaaaccccatctatattaaaaatacaaaattagccgggtgtggtggtgcatgcctgtaatcccagctactcaggaacctgagacaggagaatcgattggacctgggaggcggaggttgcagtgagccgagatcacaccattgcactccagcttgggcaacaagagtgaaactccgtctcaaaagaaaacaaaaattcttcaattccagtttcttttgactaatcagaagatactgaaccagcattctctcttggcaataattgcctagagttgatgagcctctccctccctcccctttaaaacagtacttgtattttttgttcaccacattactcatctggcctaggtggccttaacctgtctgacccctagtctagatattgagattatggcacctatgtaagctcttaccgcagtactcatagaatattccaatagcttctagttctactttgattctttctgccctctctactctgaggaccactgcaaggatatattccttaaaacacttttaaaaattatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaataggatttttttcttaaaacatgaaatctgcatttgaaaggttgttagatgtttctgttttaatctttaacatcactatgagaaccaggccaacatctgcagtgggctgccagttttctctatctgacctagactgcaaatttactgaggatagaggccagagaccatgaagttttcttccttctggtattacctcctccctccttcccacataatatctactacagtgttgactatttagtagggtcttggtaaagacttgattatcatcagaaagttcccctttaagttaaccatgatgtcctgtaaatgacatagtagttctactttctccaaatacctaaatgtgcctttgaagacaattatcaggccagctttctttttccctgtccccctttttgccagatgtaatcatctacatttcttgatctagctccattttgttttcttttaaaaaaattggttatttctctagtttctttcatttttttctgcatttctcttctatttgccatttttcttgaaatattgtacatcacaaataaagtacagtatcttcagaaaggtctacatgatgctgagcatatatttaagtttgattatttggagctaattattccatctcttgtttcttcctatacgttcaatgatgcggttgtttcatcttcagttagaatgggcggggatgtgatgtgaatatatttatttcttgtttgttaaactagttctgataaatatacataacagttggtgctaaaagaataataacatacttattccttaattttgtagctagatcctagaatagatgtgtagcgttgaattggctactgcattaacctcactttctggagctctacaaactgaaatggtccaagactcttctaggatgccttgtcttggtgctcctgagccactgctcaggcagtgagtagaaaagttattcaagagccaaggtctcttcccttaagtacctgttgcacaaaacatggatgaggaccaattgtattgttacaaattatttgtggttgccacactaccaccatgtttaatttattggaggagattgttgcatgaaataaaggtatgaagtaatgaagaggatcacatgagatgttacataatgattcagagcaatgagtttttgctgctgtggctctttgtcccttagtgccatgctggagttgtaattcctagaggttttgttttataattaacataataattagtgggaatcttttaatactctgtacatatattcaatattagagtttgctgcaaagatataaaaacaccttcattattattattttcaactctaacaaactatttcaaagtacagggtagtagcaagtactttaaggaaaaaaaaagagctttggtatcaaacatcatacctggattccaatcccagctcaataatttaccagtttatgtgaccttgggattatttaatcccattgactctatttcttcatgtgtatagtgggatcaacagtaatacctacctcacagggcaattgtgaaaattaaatatgtcccattagaaatgccatgaagtgtggcacacgtttacctatgtaacaaacctgcacgtcctgcacatgtacctcaaactttaaaattaaaaaaagaaatgccatgaaatgatatatctgggatttgcataaaaatatacattgaggtagggggagtgggttgaggtacagatgaaacaaggtttaccattagctgaaaatcattgaatctgagagtaggcgcatggggtttttgtctacttttgtatgcatttaaaatcacccataatttttttttgagatggagcctcgctctttcatgcagagtggagtgcaatggcatgatctcagttcactgcaacttccacctcctgagttaaagtgactcgtgcctcagcctaccaagtggctgggactacaggcatgtgccaccacacctggctaatttttgtattttttagtagagatggcatttcaccatgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgttcatacatgttatgtgctgccagccttcatttatttttgtggcaatatgttttctcctcttaaattctgttctttttaacatcctagtttgcccccacttccttttctctcattccaggtaagctaagcaggaaaactacaggggttttctggtttgtttgttttttctttctgctggaaagatacacgtaaatttagaattagtcagctggactcagtttagatgatcccaattttgttggcaacatccaaagcattgtaatcaggagccagtcgaacgtatgccttcttctctccatcaggtcaaatcagggtgttgatttgccacatcagtatcatagagcttcttcacagcctgtttgatctggtgcttgttggctttaacatccacaatgaacacaagtgtgctgttgtctcctatcttcttcatggccgacacagtggtcagcggaaacttggtgatagcatagtagtcaagcttgtttctcctgggggcactcctccgaggatatttgggctgcctacagagtcgcagtgacttgggccgctggaaggtgaggggtgtgtggatcttcttttttgtgtgtgtggttgtggacacctttcaacactgtcttcttggccttcaaagcctttgctttggctttgactttaggaggggcaggagcttccttcttccctttccgcgccatcttatcggggttttctgttttacagctacttctgagtacctgctgtggtggtggttcttataatttagactgggtacctcaagtcactctccagcttttgtgtatgttgaaactcttgcttttttttttttttttttttttttttgagacggagtctcactctgtctcccagactagagtgcaatggtgcgacctcagctcactgcaacctccccatctcctgtgaagcgattctcttgcctcagcctcccaagtagctgggattgcaggcatgcaccaccactcccagctaatttttatattttcagtagagacagggtttcaccatgttggccaggatggtctcgatctcctgacctcatgatccacctgccacggcctccaaaagtgctaggataacaggcatgagccaccacgcccggcccaaaactcttgaatagaaaagtcatacagagctgcctgctgaggtgctacaactggaaggtgaggttgagttttccaatggtgacaggtgtgagcctgtttgggggaaatgagataaattggaggcttttgcaatctccctttattaagtagttggtttatagcaaccatttattctctgctatggaatctgcttaaaacagaagctggaagatcctactggtacccaggtaatttcattatagctgctttatgtctccagactactgaggtttaaatctcctctctgctgtttactaacttggtgatttggtggtaagcaacttcatctctctgtgccttagtttcctcatttttaaatttcattcaattcaatttaatttttattttctgtttttgaaacagggtctctctgcacccaggctagactgcggtggcacaatcatagctcactgtagcctctaccttctggtctcatgtgatcctcttgcctcagcctcacacaacaacatgcctggctaatttttaaatttttggtagagatggggtctcactatgttgcccaggctattctcaaactcctgagctcaagttatcctcccgccttggcctcccaaagtgctggaactacaagcatgagccactgtgccaggccctctttcttcctttttaaaatgaggaaataatggtgcctactactagggttgtaaggattaaatgaagatatctatagatagataaatagatataaacagaacagtgtctgacacaaagtaagcactcaatgaatgtcggctgttatagttctttttatcaccattccattattaatgtcatgctgcagagatatcctgaaggctttcccaaaggcccattgcaacactactcttaattcctctggaagatgtgcaataaaattgtctgaaaataaatgtgtactgtagtctttctcaaaacccttaagcattgatttttatttttaaatagttccagtacttcttataggttagaggccaaagatgaatgatatctgcttaagatcttcctaagtgattagttgtgttgtccttaaatgtgttcttcttttagcagacagtttttcagaaagaaggtgctcaccagatttgaggtattagaaaatggttggggagcactataatttgagtcagaggactaaagtttcagttctgattctagcacttctaaactatgtgatgtcaggcctccaaatttattatgtgtgaaatggaaattatatgaaagctgtgtatttccttactgtaaagctatgttgatgtatataagacattatttgaattgtccaaatgctgtatcctgtcaaagcacaaggtctttcttaggcccgggtcagggtttccagtgctctgctttctttttagttgtaggttctaatgactctgctttgcaccccttgtcactttatctctaggcatttttccctttcagggttggccaaaggatgggatgttttcttcttagccagcacctgctccagttccttggaggcactgttcacttttgtaagacaagctgatcattataggaaatgccacttttgtataatataaacttggggacatgacaaaagttacataattttatcaaactcctgtagtcacagtacctggaatgtggtttgtgatgtcctgcatatatgagacattgacccactggcgatgggactcaatcttcttccctatttcttcctcctctgtttccttctataggacccatgcccttaggagaaggaccagaaagtccagcttgtagacacaaaggcttgaagagccaatccaagcagaataatggttattacctcaagttggtaatttgcatttctggtgtcctcctgcctgagtgattcacatctcaatggcccaggccatatatactataacccccttttgtatatttccttaccacttccctgacagcttttgtgcagctgtctggtctctcttaggcacttagagcagaaattccaactctagagaagagcaagaggctcataaatccctcttcaaaaaaaaacagagccttctttaagaccttctgtgggccttaattttcttcagttttcaattttgcctgggtaaatattttttaaaattaaatttaaaaaaggaggttatataccttcccagtatctttccttatagtcattcctaccaatatttagaaggttgaccaggattacctaatggctattccatttggctgttttctgggtgagggcactagccagaaatggctgagacattattaattgtcagctctccctcttatactattttactaaaatatttgtgatataggagggccaagaagtatttttcaggctccttgattgttgctattaaagcttttgaagatgggcagttatagttctggatatggctctatctttcctcatttccctgatcattcattcctttattcactggacattagtacatagtgtataggagatgctctgctaaaagatagggatacaaaaaaaggaacaagactaggtaactattgaagggctcacctggtggtgaaggaaacggacagttcctctttgtgccaggtactgttgtaaatacttgaacatatatcaacttgatacatcctcatagtaattctgtgacctggtactataattattcccattttacagatgagaaaacagacacaggaggctggaaaaactttgcccaacttcttactgttaagaagtcacagaatcagaatgtgattctaggcactcactccagagcccacatgttttactacactttgagagcaatgtggagtattgaccagaaggggaaggaagtgactatgaaatgatgaagggctagatttaagagatatatctgcaggagaattattatagctgataaccaactggctgaagatagggagagaggagtcaaaggtggctgacccctaggtttttagactgatagactgggtttatggtggtgctagaaattaagattagaaatataagaggtggagcaggtttgtgaactcatggggtataaaagtcctatttgatacacaggacagattctttgggccagagttcaagattctgataatcaacaataataatggtggtgataatagctaactgagagtgttctatatgccaggatttgttttaagtgtatttacatgtacagttattcatcccttaatgaaggggatatgttctgcaaaatacatccttagacaatttttacattgtgtgaatatcatagaatgtactaacataaacctagatggtataatctactacaacctaggctatatggtatagcttattgctcctaggctacaaacttctatagcatgttactgtactggacactgtaggcagttgtagcataatggtgtatatttgtgtatctaaacatagaaaaggcacagttaaaatatggcataaaagattttaaaatggtgtacctgaacaccacttaacatgaaggaaacttgcagaactagaagttgctctgagtaagtcacttagtgagtagcgagtgaatgttaaggcctaggacattactgtaccttactttagactttttaaacagtgtacactaggctacactaaatttataaacaattttttcttataaattaaccttagcttactataacttttttagcttaaaacacaaatcctgtacagctgtacaaaaatattttatttctttgtattcttattttataagcttttttctattgttaattattttttttttgctttttacaagtttttgttaaaaactaagacacaaagacacatcagcctaggcctatgagggtcaggatcatcaatatcactgtcttctaccttatatcttgtcccactggaagatcttcaggggtaataacatgcatggagctgccgtctggtatgacaacaataccttcttctgggatacctcctgaaagacctgcctgagaatgttttataattaacttttttttagtaagtagaaggagtacactctaaaatgatgatagaatgtatagtgtagtaaatacagaaaacaataacatagtcatttgttatcattgttaagtattacatactgtatataattatattgactgacagcacagtcgatttgtttacaccagcatcaccacaaatacatgagtaatgctttgcactgtgacattacagcgggtatgatatcactaggtgataggaattttttagctctgttataattgtatagaatcattgtcgtatctatgagaacacttggacacaggaaggggaacatcacacactggggcctgtcatggggtggggggagagcggagggatagcattaggagatatacttaatgtaaatgacgagttaatgggtgcagcacaccaacatggcacatggatacatatgtaacaaacctgcacgttgtgcacgtgtaccctagaacttaaagtatgaaaaaaaaaagaacagtgtcgtatctgtgggtcatcgttgactgaaacgtcattacatggcatatgaatgtattaacatggaatgttcacattaactctgttaaggcaataccgtgttaccccctcttttggcaggtgaagaaactgaggttcatagaagctaatatagcctctcagaatcactctgcttcctcaactctgctgtctcttaatccataggaatcgaagaacagattggagttggctgtcttaagttgtacttgctagaaataatgaagcctgttgaaggtgttgtgtgaatgcagagggagaatcgaatcttctccactcctacgcatggttctggcagcaacaaagaaagctctcctggcgttttggtgcccccctgtgggctgtatgagagttacctgacctcacattctttttccaccatcacacctccttttcctgtcttagaaatcagaaaaagcttagctaccctctctaccacctctcacttcatagttaattacacctcaggcatctttcatgcataaattctctaattttctttcgttcttttccacccttttccaatttctgtacttgagaaaacacattccctcactctccttttctgtcactgtcatcaaaaaccttcgaaaatgtgattaaacacctaccatgtaccaggcaatgttctagggccttggaatacattagtgaaaaaaacaaagatgaaagtatctgcctgcaaggagctcagattctattggaagtcagttttcttaattctggcttctactattcttattacttactacagttcctccattaacctgttaaaagagaaactttagacaaattacacttaacagtttaatcgagcaaagaatgattcatgaatcaggcagcccccagaagaaataatagattcagagcaactctggggctgccatgtagtcagataatatttatggacagaaaatggaagtgaggtacagaaacagctggattggttatatctcagtatttgccttattcaaacactttgagttgttgactgcctgtaattggctgaaactctgtgattggcgcaacagtagattacactgtctacacatccagttaggttatggttcattatggatggggaaacctttaggctgaacttgaaatatgtaaggaggaagctttaagctaaccttaatttaacaaaccccacccccaagttccatggaagccttagggttctgcagaggatagtctgaaatcttttaatcatagatggacaagttgtggcttaggaaaaaaaaggccttgccaaagattatgggatgtgagtgctgcacatctaactcccagaaaatctggttgaggaagaaagctagtaggtgcttctagtatgaatgactgatggtttaaggcagctgaattaagacactaattcctttttttaagaggaaaaactaaagaagaaagagaaaactgtttttattaccccacctggcttgcagatttaagagacgtagacagataaaatacgtctctagagagatttggccttgatgtgtaaataagttcactcgggtaaatatatatataggagcttggaactccttcaagcaagaactagaccaggaaggtagaatactgaaaactgtagctatactgatgttcctctgaaggcagagcatgttggagaaataggaagaaacagattacctgcatgcagtttggtggaggggagcagctaatattattggggaaaagttaggtccatcttgatgagtaaaataaatcagaaggtttcaatgacttatcagtatctggtaagcactgaaagataaaggtcatagaacacacataacattaatggcatatttatgcatatagtgggttagattttattctgaaagttgtcttttccttttctcttttccagatatggataaactcataaacaacttggaggtccaacttaattcagaaggtggctcaatgcaggtattcaagcaggtcagttatcaggaaaatagggtgctaatattgggccataatagtattgaatacctggtagtgattacagaatttaaactcatttttctttctataacatgtttggggattgagaagaggtgaaggaagacatatttctagaaagtatatgaatgccttggtttcatagtcagctggggagtagatctggcctaaaagaaacatagcctctggaatcaaggctataaagacaagagtagacctttagtagacaatagcaactatttatatagcactatttcatatttcagataggatgaagattaaatgcattgtcttatttaatcttcaccataatcctgttgaacagtgtattaattagtattctccagagaaacagaaccaacaggatatgtgtgtatggtgtatgtgtgtgtgtatgcatatatgtacatggagagagagagagagagagatttcaagaaattggctcattagattgtggaggcatggcaagtccaaaaccccatcaggggtaggccggcaggctggagattcagaaggagttacagtttgagtccaaaagcagattgtgagaagaattctttcttgctctatggaggacagtctttgttttaaaaactaaggtcttcaactgattggttgaggaccactcacattatagagagtaatgtgccctatttaaagtacaatgttttaaatgttggtctcatccaaaaaaataccttcacagaaacatctagaataatgtttgaccaaatatctgggcactgtagcccagccaagttgtcacataaaattaaccatcattattcttagtttccccatttgatggaaaataaaactggccttgaacactccaagaattaggattcgaaacaggttatctggattttatgtcccagggctctgtgctagatgttgaagtcccgtctttcttggggttgcaaattcactgcatgagtgaaactcaaatacagtcaaaattaaccttgaaaatccttaaatcacctatagacttgagtatacagtgttgtatatacaatacttgtctgtttctttatttaattcatcagataaagttggttacatttaggaatctttttgttataatttcaacttttattttattttttgaatttttatatatttatttatttatttatttatttatttgagacggagtctcgctttgtcacccaggatggagtgcagtggcacaatcttggctcactgcatcctctgccttccaggttcaagctattcttctgcctcagcctcctgagtagctgggactacaggcacgcaccaccatgcccggctaatttttgtatttttagtagggacagggtttcaccatattggctaggctggtctcgaactcctgacctcatgatccgcccacctcggcctcccaaagtgctgggtttataggtgtgagccaccgtacctggccttatttttaatttttgtaggtacatagtaggcgtatatatttatgggatacattgagatgttttcatacaggcatgcaatgtgaaataatcacattatggagaatggggtatccatccctgcagcatttatcctttgtgttacaaacaatgcaattacactcttttagatattttttaagtgtacaattaagttattattgactctagtcaccctatcatgctatcaaatagtaggtcttatttgttatttccaacttttttttgtttttgagatggagtctctctctgttgcccaggctggagtacagtggtggcttctcagctcactgcaacctccgcctcccagattcaagcaattatcttgcctcagcctcctgagtagctaggactacaggcacatgccaccacgcccagctaattgtttgtatttttagtagagacagggtttcaccatgttggccaggctggtctcaaaatcctgacctcaggtgatctgcccatgtcggcctcccaaagtgctggggattacaggagagagccactgcacccagacaatttctaactattttttcgtacacattcaccatgaccacctcctcctcaacaccccactgcccttcccagcctctggtaaccatccttctactctctatgtccatgagttcaatggtttcgatttttagatcccacaaataaataagaacatgtgatatttgtctttctatacctgacttatttcactgaacataataatctccagttccacccatgttattgcaaatgacaggatctcattctttttatggctgaatagtactccattgtgtatctgtaacacattttctttatccattcatctgttgatgaatacttaggttgcttccaaatcttagctattgtgaatagtgctgcaacaaacatggaagtgcagatatctctttgatatactgatttcctttctttttggtatatacccagcagtgggattgctggatcatatagtagctcaattttcaatttttttgaggaacctccaaattgttctccatagtggctgtactaatttacattcccaccaacagtgcacaagtgttttcttttctccacatcctcaccagcatttattattgcctaactcttggataaaagccattttaaatatctcattgtagttttgatttacatttctctgatgatcactgatgttgagcaccttttcatatacctgtttgccatttgtatgtcttcttctgagaaatgtctattcaaatgttttacccatttttaaattgaattattagacttttttctattgagttgtttgagctcattatatattctggtgattaatctgttgtcagatgggtagtttacaaatattttctcccaatctatgggttgtctcttcactttgttgattgaatcctttgctttgcagaagctttttaattgatgtgatcccatttgttcctgtttgctttggttgcctgtgtttgtggggtattgctcaagaaatttttgcccagaccaatgtcctggagattttcccaaatattttctgcagcagtttcatagtttgaggtcttagatttaactctttaatccattttaatttaatttttgtatatggttagagatagggttctggtttcatttttctgcatatggatatccaggtttcccagcaccatttattgaagagaccacgcattccccaatgtatgttcctggcacctttgtaaaaaatgaattctttgtagatgtatggctttatttctgggttctctattttgttccattgcactgtatgtttgttttcatgccaatacaatgccattttggttactatagctctatagtataacttgaagtcaggtaatgtgattccttcagttttgttctttttgcttaggataacaggctattctcggtatttgtggtttgatataaattttcggatttcgtttttctatttttgtacataatgtctttttttctttttcttttttttttttttgagatgttgtctcactctgttgcccaggccggagtgcagtggcacaatcttggctcattgcaaccttcacctcctggcttccagcaattcttgtgcctcagcctcccaagtagcagggactatgggcatgtgccaccatgcccagctaatttttttttttttttttggcagagacggggtttcaccatgttaaccagactggtcctgaactcctaacctgaagtgatccacccacctctttgtgttcccaaagtgtgtcaacagtgaacaatctgacaaagcaacactttgcttcccaaagtgttgagattacagacatgagccactgcgcccagacaagaatgtcattggtattttgatagggattttattgaatctgtattgtgttttaggtagcattgaagcaggatatttccttgaccccttcgtgggtgggaactggagtgcactggtgctggacctagctggcgctttggcactagcaggggcgaattccactcacttaaacctgctgtgttctaccccttgtgggaggggaatcacaggtcagtgggtgcaggagctggggtgagtgcctttgggcaccggcaggagcaaaactctatgcgcaccccacagcagagtccggggggcggggtgcctgcgacccttgaagccccagaaggagtgttacagtacccttttagctttgctgtttgcagatggcttaagcattaacagctcaccagagggtcagtgtgacagccttctgcacccacactgaagttcttgtctggcatccaggaggaatgaggttacacaatgaatcaaaggtggttaatgtgggagattttattgctgatcaaagtggctatcagtgggagggggagctgaaaaggggatggagtgggaaggtaatcttcccctggattccagctgtccccatctggactcctctccaaagctatgccatcaagctgtccctctgaagtcaagccacttctctccaacatccaactataatctccaacgtttagctgcttctcctctttctgccagctgagcctgggtttttatgggcacaggatagggggcagggtcaaccatgggtggttttggaaaaggcaacattcaagcaggaaaacggaaatataagttctcactttggactgtggttccaggcttcagggtggggccctcaccagggacctgcccacttctgcctagaatttccctgcctcctgtccctgtcagtatggacatttcaacaatattgattcttccaatccatgaacatagaatatttttccattttttgatgtcctcttcaatttctttcttcagtgttttatagttttcattgtagacatctcccacttctttggttaatttgtaggtatttaattttatgtgtggctattgtaaacaggtttacttttttatttctttttcagattgttcactgttgacataaagatgctactgatttgattagtttgattttctatactgcagctttactgaatttgtttatgggttctaatagttttttgtggagtttttaggtttttccaaatataggatcatatcatctgcaaacaaaaataatttgacttctttttttccaatttgaatgccctttatatctttctcttttctgatggctctagccaggacttccaatactatgtggaataacagtgttgacaatgggcatccttgacatgtgccaggtcttagaggaaaggctttcagtttttccccattcgatatgatactagctgtgggtctgttttatatggcttttattatgctgaggtgttacttgtatccccagttttttgaagggatgttgaattttatcaaatgctttttcagcatcaattgaaataatcatggtctttaatccttcattctgttgatattatgtatcacattgattgatttgtgtgttgaactgtctttgcacccagggatcccacttggtcaggatgaaggatctttctaatatattgttgaatttggtttgccagtagcttgttgaggatttttgcatcagtattcatcagagatattggcctgtaattttctttttttgaagtgtctttgtctggttttggtatcagggtaatactggccttgtagaatgagtttggaaatagttcctcctctatttttcagaatagtttcagtagaattggtatgagctcttctttaaatgtttggtagaattcagctgtgaagccatcaggtcctgggcttttctttactaggagactttttattatggcttcaatctcattacttgttattggtctgttcatgttttggatttcatggttcaatcttggtaggttatatgtgtctaggaatttgtccatttttttctagatttttcaattcattgacatgtaattgctcatagtggctactaatgatcctttgaatttctgcaatatcagttgtaatgtctcctttttcatttctgatattatttatttggatcttctctctttttttctcattagcctggctaaaggtatgtcaattttgtttaacttttcaaaaaacaactttttgtttcactgatcttttgtattttatttcaaattcttttaattctcctctcatctttgttatttcttctactaattttggggttggtttgctcttgtttttctatttttttttccaaaagaatatgcaggtatcattgcttttctaggtctttaagatgaattattagattgtctgtttgaagttttttctgtcttctgatgtaggcacttacagctataaaacttccctcttatgactgtttttgctatattccataggttttgatatgttgttttccattatcacttgtttcaagaaatttttcaattttcttcttaatttcttcattgactcactggtcattcaggagcaatttttgttgtagttggtttttttgtttgtttgtgacagagtttcactgttgttgcccagtctggagtgaaatggtgtgatctcagctcactgcaacttctgtcccctgagttcaagtgattttcctgcctcaggctcccaaatagctgggattacaggcatgtgccaccacacctggctaattttgtatttttagtagagacggggtttctccatgttggtcaggctggtctcgaactcccaacctcaggtgatctgtctgcctcggcctcccaaagtgctgggattacaggcgtgagccaccttgcctggcaggagcatattttttaatttccctaattaagttaaagtttaataatattattaaacattaataaattaatgttttataatactactggtgtatggtgtttgtatagtttcctaaattcctcttgttattaatttctagttttattctattgtggtcagagaagatgcttgatgttatttcaggttttctgagtgtcttaaggtgtgttttgtcacctaacgtatagtctgtcactgagaatgatccttgtgctggggaaaacaatgtgtattcttcggccattggatgaaatgttctgtaaatatatattggatccatttggtctatagtgcagattaagtctgatgtttctttgttgagtgtcttcaacttttattttagattcaggggatacatgtgcaggtttgttacatgggtgtattgtgtgatgccgaggtttgggatatggatgatcttgtcaccatggtagtaagcatagtattcaatggtttttcaacccttgttctcctctctccctccttcttctagtagtacccagtgtctatttttgccatctttatgtccatgagtacccaacgtttagctctcataaataagaacatgcagtatttggtttcctgttcctgcattaattcccttaggagaatagcctctagctgtatccatattgctgcaaaagacatgattttgttcttatttatgtctacatagtattccatggtatatctttaccacattttcttgatccattccgccatcgatgggcgcttacgttgatttcatgtctttgctattgtgaataatgctgtgatgaacatataagtgcaggtatatttttggtagaatgatttattttcttttgtatatataccgagtaataggattgctgggtcaaatggtagttctgtattaagttccttgagaaatctaggagtcagttttaaaaattgttctcaatcattgtttggcccatggtgtataaatgaatttgcttaagttgcatatgcatatggatgagaatcctttgtactgttttaatgatatttagccctatttgatgtcccatttaccttaatcgtagcttttgcatttaggaattattagcacatcaaaacttgctaattgttggaaaacttctgcctgttgctagagcttactcatagttaataccaagaggaagctgagtataagtagtattagataaaaatctattgtacttgtaataaaaaatactctatgaaatgtcattgagcgtgcatagctacctttgttgttgttgttgttgttttgagatggagtcttgctctgtcacccaggcttgagtgcagtggtgtgatctcggttcaccgcaagctccgcctcctgcgttcacgccattctcctgcctcagcctcccaagtagctgggaccacaggcgcctgccaccacacctcgctaattttgttttgtactgttagtagagacagggtttcaccatgttagccaggatggtcttgatctcctgacctcgtgatctgccagcctcggcctcccaaagtgctgggattacaggcgtgagccaccgcacctggccaaagctaccttattttgagatctcagtgtacctaagtataattctagaaatgtttttctatgcattctttaggtatactgaacttccagaatttggaggcactttgaaattggttcaatgtgtagaaaagtctggatagtaagggatctaagcactttttttgtttgtttcttggcatttccaggatatcttatttttagaaaagcctgagtgcttgtgatacatggccacagcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaataaatctatattagttttgtcctaagctatctggagaattctcggtttgatgtgaagtattactttcctagaattgctgaaacaaactaccacaaactaggtgggttaaaacaagagaaatgtgttctctcactgttctggaggccagaaatctgaaatcaagttattgtcagggtcatgctgcctctgaaggctttagtgaagaaacttttccttacctcttccagcttctggtacatataggtattctttggcttgtagccccatcaccccactgtcagcctgcatcttcacattaccttctcctctgtggctctgtgcgttattcctctgtatgtctcttataaggacactagtcattgaatttagggcccacccagataatccagcaggatctcttcaagatctttaattacatctgcaaagatactttttccaaaaagactctgggaattgaggtgtagacgagtgtttttgagggtcaccattcagcccactacaatgtgttatatatattttccaatgtacagtacaatagagtaagcataaatattaaaataaaataacttcatccatgtattacccaaaaacaaccttagattctttgagaaacaaaaactgatttagtatttttcacattttctatagttttgtgctaggtactaagcaaatacctagtgaacaaatatatgcatacatatacatatgtacatacatttgtacatttatgatctcattttgcctgattgtggctactaccatcccaatctcttaaaattgccgggtttgttagattaagtctaggtttctaataatacccatctccatccaccgctccattttctaatacccaaacagataatgctcttattggaaaaagaattgagttttagaaggttaaacagactttttgacctaaacatgaatgtgtacaatacatgtgtgcatatgtatccaggcataaaactaattggtttaacccagagcaaagctggaaggtacctgtttacaaaaacaggtttcctctttctgtttgggaggagcctaggctttatcgtgtttctataacatcccttcctctccttccacctactgtgctgtatatagtattttgttcttcatttctaatcttgcattaccactttcaagctccacatcagagctgtttcaaatacatgaaaaatggaaactttgtaacagttgattccactgattctcagggcctctctacctatcttaatcaaatgcttaaatatttgtgaaattaaccaacttttctcagagtttatttctagaattgagaggggtgtttcctaagaaccgaaagggtctcatctttagtaatatatgaataaataactctttttatatttttttgtccactcaaattggcttaaggaaacctgataaggattctgggtatttgaggagtagcactgtggaaattaaagcttgtcttcaaaccacccctaagtttctttgttttctttcatgcacaaccttcttcatagattcagaaatccggaaattcaggataaagtcttaaaatagcaaatggggaaagtagctattctctttgatagtgattgactagagaacacttaaaaactgaagccatcacaccacactaaaaatgaagaaagattactttaaaagaaaaatctgatgacagaacaatcctcagatgagtttcaaagctgaagtgattatattcaatgaagcatgaaataggtagccatcctgagtcatcttagtgaggattcttaaaatcaccaaaattctagggacaaaaactcactcaatcaagacttgaaggtcttcttcagaaccttcaagcataatatgctatctataaagataaggtaaagcaaatagggtgttggggttttttttaaccatagggagggttatattcaaactatggaataagttagactgtataacaatatttttattaaaattattttgatcatattgaaaaaagaatcctcagtgcacacaaacaaaacttattcaccctgatagtgtgtagatatggaatgcttgtctttaagccacaaaggaaggaacagtaaggtcaaccttgagacctacttttgagaacagtctgttttcttaagaaagcttgcattcagaagacaatatttacacccagaaaatacttgctacaagatagattcacttagacataagaggcatacttgggagtgatatgtacagaaaaaagtatgtgacactatgctttgaggaagttactattaagatactaaaacccaaacaactccccttccaacacttctctcaaagccttttgatggcaggagagaagtaatgattgaagccctgctgcagacagggtttggttaagaattggcaaaccacaaaataggtttagtctatgaaaggacaactaatgatggcctgttggagcaggaccctgtaacactgtatctcatcaaggcaataagaataggctatcagttcttcagtttcttgactttcatcaatcagtttccattttagatgttcctacgtaatgtttttcaataaaatgcatacctgcagatcaagtatcagctaaacacaaggccttgagctagtaacattgttgtaggcagcactcatctcactgaaatggcctttctttggcaaaagagagtaaaagttgccaaagtcgtgtttattttatagttaggattcaaagcttcagctttttcaggtttcttagtccaaaaagtccctaaaatttagctaaatcttttcttaatttcagtggcaagttgtgtttatttatacacctgcacccacaactatattcttacagaaaatgatattacagtgaattattattattattattattatttttgtgtgacagagtctcattctgttgcccaggctggagggcagtgacaatcctcctgcctcaacctccagagtaactgggactacaggtgcatgctaccatacctggctaatttttgcatttttagtagagatggggttttaccatgttggccaggctggtctcgaactcctgacctcaagtgatccacctgccttggcctcccaaagtgctgggattacaggcatgagccaccgcgcccgccctacactgaacctcttcttatgctttctattgtaactctatttctcactgttattgacagcaatgatagactatggaaagagataacattttttcttttgaagattccttggattctatctttttaatctgggaatggagctactcaagtgaagagttatgtgggaaatgtaggaaaaataagagcttaagttgatttgggggattctgagaacaggggagttttatgttcagcagagccaatcttgacaacttcctctccctgtcaacaggattctactccccccttatctggatgggtcaaatccacccatgagggatgggttacatttgcagtatgtgaaacagtgggacaaatcacagaaatcatgtcctggaggagcagattgaagcaatgtttggaccacaaacaagggctgagttgggataggtgctggcaaatcaagaaaccaagagtgttgtagcataaaagaagggaaaagaagatggcagtctggccaaattctggagacaaagcacggatgggtttttggtgccgttactcattcccagcctgctctgagcattgttgtcatgtgtttttgacgcagagtcttgctctgtcacccagactggagtgcagtggtgtgattatagatcactgcagcgctctgagggtttttaaaataaagtcagagcaagaagacactgcctcccctgccacttattgctctctgaattcagacccttattatctctcacctaaattttaaaaaatcataagcataacataattatcacaccttaaaattaactaattcattaatattgtccaatatccagtcaatactcaaatatttttacatgtctcatcgagatttttccacttgctttcttttgaatgtctttgaatctagttttattcctctttcaatcaatcttcattaagaagctagttaaatctcacagaaatagttcttcccttgttactcctctcttccaaacaattatcttctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgacctttgaattcatggaattcttagaaagtttttaattaggttgaggctttatttcatatattacatataaatgatcatttattagttttttaaaaaaagtattagttttttattaaaaactattagttttttaaactaataaatgtatttattagttttttaaactaatgtatttattggttttttaaactaataaatgtatttattggttttttaaactaataaatgtatttattggttttttaaactaataaattggttttttaaactaataaatttatttattagtttaaatcatttatgatcatttagatcatttattagttttttttaaaaatcccagaattaaaaagttgcagagttcaattttgcatataatacaactaactgtattgcaagtttatttcatagtttattctataattatactgtctgttgttatggctctatagacaggaatatctttcttatctcttatctgcctagaaaatttctattaattttctatgactcagctgaaatatcacctcctccttgaagccttccctttctagtcagaatgagtcattcccttttgtttttctaaaacgccttgcttgtatgcctgttacattatttattatggtatgatttataaactattcacattattctatcattatatttaatatgttggtatgtacttattggctgtactttattgatgtgtgctgccactgagcttatagtagatgctcagaaagtgttgactttaaataattttgcaagattattgtgaacgttaaatgaaataatttttaacaattgccggatacagtacctggtacttacagatagtaaagtttcccgtctgtttttctctttagtttactcctgccttatttctcccagcaccatgtattccttccatgtgaaatgaatagagatttcttttttacattgcttgcatgtctcttcagggtactaacactgacttatgcatctctcatttgtttatttatttaaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggtaagtaacaatattgcctctttcctggccttcctgaatctattcccttttagagtcatcctatctcctgtctcttttcacttcctccaattattcttgcacactgcttcaagagtaatctttcaaaagtactgttttttatgtctttttaatgcttaagaatgtacaatgagtcttgattagaccatgcttctcaaacaagtacaagtatgcatatctatcagtgacatatcaaacaacttcctggaacttccacattatttgatattaaataatttaagcattttatatttaaaatatgattatcttgtattacaaaatgcaaaatttaaaaacctgttaagataaaccacatgcttcaaaaatagttgaagcttactaaaggcatccaccctcggacttttcaggagaatgtgtttattttatgccattcagaatgctttggtgggaaagttgagaacaatatttctatctcaaacatacttagccagtattagctcctgcctctaccaatactttcccttttctcttccctacaaaagaagtaattgaaatattgtcatcttccctgtgttcttcctcatttggcatctatcactttccattttacttatttatttgcctgtatcacaagagtttgggcattattcacaactgaattgtaaattcctgaaaaataatactctatcttaatttttttatgtatgcctccagagaacttaacacagtgctaggagttgtcttgcaacagataatttgatgaacaaacaaacttgaaaatttgtccaagagagaattcaaatgctataatcttccattttattttatttttaaaataagttcagaattcagaaaggtataaattaagtctctcttccaccactatcccccaaccactagttttcctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatggtggcagcaagagaaaaggaagaaagaatagcggaaagccctgataaacccatcagatctcatgagacttattcactatcatgagaatagcaggggaaaactggccaccatgattcaattaactcctcctgggtccctcccacaacatgtggaaattctgagagatacaattcaagttgagatttgggtgggggcacagccaaaccacatcagtatccaaaatggggggcttactaaaccttagggggcacatataaaacaattggagtgcaagaagaaagtatcaaaatttgtattttcttacccttaaaaattgacaggtaatattgtatgttttaatcatctatagcatgatgttttgaagtacatatgcattgtggaatggttaaatctagctaaataataaatgcattacctcattatcatttttgtggtgagagcacttaatgtccattctctttacaattttaataaataaaatgtatcatcattaactatacttgccttgctatacaatagatctcttgaaatgtattcctcctatctagctataattacgtatcctttgaccaatatctccccatccccctccccactagccaccccagcctctggtaactaccattctactctacttgcatgagattaacttttttagattccacatatgagtgagatcatgcactatttgtccttctgtgcctggcatatttcacttaacataatgtcctccaggttcatctatgctctcacaaatggcaggattttattctttgttataactgaataatattatattgtatatatatatatgtcacatttcatttattcattcatttgttgatagatattttaggttggttccacatcttggctgttgtgaataatgctgcactaaacagggatgcagttatcttttgggcatgtgattttatttcctttggatatatacccagaagggagattgccagatcatacggtagttctaattttaagtttttgaggaacctccatactattttccataaaggctataactagtttacattcccatcaacagtgtgtaagtgttcccttttctccacatactcaccagcacttactgtcttttgtcttttcgataatagtcactctaacttaagtgagatgacatactactttttgtttgttttcttataatgtatacaaaattgtaggataccgatacatgtatatcacatacatgcacaaacatgcacacctcaagatacatgcttaaaactttttagtgaatgatatgcaaagtatagagacaactcttttaaccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgcaaaaaaaaaaaataaaatgttattctcttccttccatgcaaatacacttctttcatcttgttttttatttctttatttttctgtcttgctgccacttcttaaggtgggacaaactgggaatcctgaaaatgattaaagaggcacatacatcttcagctcacactgctccctttctttgcttttagtgaaagttgaccccacctccatgtctccactggaaattccaagtgacagtgaggagagtacaattgagagtggatcctcagccttgcagagtctgcagggactacagcaagagtgagtactttttgtcttcaagtctgtctttgtgtatgtgtgtgtgtgtgtgtgtgtgtacatttgcacatatgtataggtggaactaatgatcagacacaagagtaagaatttgaggacaagaaatatagggagactgcctttccagtgaaagtatatgagtttgtgtgcacacatgtgcatgtacatgcatgctatagtagagctatgttctaactgtagatcatcaatttttcttttgaaaaatcttcaaatttcccataaagtgtagttatgtactgtttctctctgtaagtttaaaacagctttgtctttcaatattgaaactaattggaagtagttggcttgtgtttagcaacaactgttgtatgaaaaacaaatttctttaagcaggaaaatgaaacttattgaagtgaaatgctcacactgtttgggaacacaaccactgaaggaaacactaccacctcccatgctttctctgagcacctactgagggacctgtacctactgagcagaatggcctagttgacagaattgtttttactattccaattatttctttttggggggacctagcattaaattcacgtaaattaaaagccgatatgatgtggcaccaatgaatgtaaattcatttttttagccttcactttaaagtcactgtttggctttatctctatttctttgatcagaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggtctgcccactcccatctcacccccaacacacacacacacacacacacacacacacacacgagagagagagagagagaggggcagagagagagagagagaggggcagagagagagagagaaaatttctgagagacagagaatgaagtcctgaaacaaagactgatgcatttatactcatgggcacaggctccattcatggtttttatccctatttcttgtccctactctaaggcagattttataaaactggcctaggaaaacactaaactaaatctggtgtcttaatagtcatcattcccagtgagccctgtgggtctttctaattgcggagtcaacacttaagcaaagattaaggcattactcccttccttactaccagggtctcacaagttttactaagcatggaaaagcacaagaacaatttaaactatgtgaaattaaagcaggttgtaatccactaaccattaacgtgtctttgttcacattaaaaaaaaaaggtgcacataaataaataaagcagacctggtagtgatcctgtcaaaccgaacagcacatacctgatctgaagaaggagagctgccactcaaatccatgtagtcagccatcaatattcttaggttccacatccgtggattcaaccaaccacaaatcaaaaatattttttaaacaacaaaaataacaatacaacaataaaaaaatacaaattttaaaatacagtataacaactacttacatagcatttacatggtattaggtaacgtaagtacatctagagatgacttaaaatataggagagaatgtgtatagattatatgcaaatgctatgttattttatatcagggacttaagcatccatgaatttcgttatccacccgatgggtggggttgggaatgtaggtggctctgaaatcaatcccccatggatactgagggacgactgtattagtaaatttaattgttaaagaaaagcaaaaaaaaaaaatccagattattatgtgaaatgtccttgattttgaatgttggcttctagttcaaaaattttttataaccccaggaattcaaagaaacctgcctagaagccagatgcagcttgtcatttatcaatgtgtgccctttgccttggagactccttctccatagtggtctccaagctcagaattgggacttagacaccttggacaaggaggaagccctcctttcttgtaaacatctgctatgttacctttgctgtgttagaatttgtgtagaaggacccagagccctagttgttttgcctagaggctatgaacaggtgagtgatttccaggctgcattattcaaacattcccatgacactattattatttagtgatgtatttgtttgcttctcttccatgggagatggatgctgactatatatatattccatatattccaagtctccaattaagctgctgtgggatctgatatgtcttcctacctctttgatcttaggttcctcaaccgtaagatgaggggtttggactaggtaatcccacttgactattttaatctggaactctatggattgaatttcaatgtaacctattgtgcggctaccttctaggaggtcccaagtgtaggcaggttggaaattactttatgatatactaaaagtctggctgtctttcctatgtcacctctcgactcttaaactgagataacagatacaatttacttttatttacttttcggatttcagtactgtttttctccctagtggtgtaagcttcccatatgaagggaaaaaatggccctaaaatatccacaattcttagctttgagtgttataggtgaatgccttacctgataagagatcatgacagccagatgactgatgaatggagacaactgatgtctacatgaatctcactacatttttttttttgagacagttttgctctgttgcccaggctggagtttagcctggcgtgatctcggatcactgcaacctctgcctcctgggttcaagcgattctcatgtctcagccacccgagtagctgggattacaggcatgtgccaccttgcccagctaatttttctatttttagtagagatggggttccaccatgttggccaggctggtttcaaactcctgacttcaagtcatctgcctgcctggacctcccagagtgttgggattacagacgtgagtcactgcccctaacctcactttgtttagattcggaattgttcttattctactcagtttttaggattgacccatacctttgccatgggtatgtgaccataggaatactcacttgaaggcatttcacagaaacatttaatttgccccaactgcttgacttacaataggcttagttgctttaggaaataacgtggcatttctgtaagtgccctcattcctgcagtattgtaataggcctttcctcactacaattcattctccacacagtagccagaggattttcatctgtttgcttttgttttgttttgtttaaatataaataagattatataacatctgctacttaaaatcttccaaggacttcccatcacactctgaatgaaatccaaatagagtatcctaaaaggccctacaggatcttgcctcttattaattttatctcatgacatttcttatccttttgatcccaatttgaatgtcttctgcccagaaaaatcttccctaaacctatcttaagcagtgtccactctcaaatatctgtataagaaaaccctacttaatttcttgatagagttttcttttctttcttttaaaatttttaataatacatattttaacccagtgtatcacaaatactatcactttacaacctaatcagtacgaacaattatttttattttattctcatattttgtgggtacgtagtaggtttatatatttatgagttacatgagatattttgatacaggaatgcaatgtgtaatagtcaaatcagagtaaaggggtatatctgtcccctcaagcatggggcatcctttgtgttacaaacaagctaattatactcttttagttattttaaaatgtacaattaaatgattttttttttactataatgaagctgttgtgctatcaaatgttaggccttattcattctctctattttttgtacccattaaccatccccactgccccccgacccactgacatcccaccatccttccctgcctctggtaaccatccttttacctctatctatgtaagttcaattattttaatttttagctaccacaaataagtgacaacatgtgaagtttgtcattttgtgcctggcttatttcacttaacataatgacctccagttttatccatattgttgcaaatgataggatctcattctccatgtgtgacctttgccttggagactcctccttagtggtctccaagctcagaattgggacttagacaccttagacaaagaggaagccctcctttcttgtaaacatctgctatgttacatttgctgtgtgagaatttgtgtagaaggacccagagccctagttgttttgcccagaggctatgaacaggtgagtgataaatgtctttttagctcttttgcccatatgcaccacattttctttatccattcatctgttgatggacaccagttacttccaaattctggctattgtgaatactgctgcaataaacatgagagtgcagatatctcattgatatactgatttcctttcttttggatatataaccagcagtgggattactggatcttatgatagccctactttgttttctgagaaacctccaaattgttctctatagtgattgtactaatttatattcccaccaacagtatatgagggttcctttttttccacattctcaccagcatttgttattacctgtattttggataaaagccattttaactgaggtgagatgttatctcattgtagttttgatttacgtttctccgattatcagtgatgttgagcaccttttcatatgcctgtttatcttcttttgataaatgtcttttcagcttttttgcccatttttaaattggattattagatttttctcctatagagttttttgaactctttgtatgttctgattatgaatcccttgttgatgggtagtttgcaggtattttctcccattctgtgagttgtctcttcactttgttgattgtttcctttgctgtgcagaagatttttttaactttatggcaccccatttgtccatttttgcttttattgcctatgcttgtggggtattgctcaacaaatctttgcccagttcaatgtcctggagactttccccaatattttcttgtaatagtttcagatcttagacataagcctttaatccattttgatttgatgtttgtatatggtgagatatagggttctagtttattcttttacctgtgatatccagttttcccagcaccctttattgaagagacagtccattccccaatgtatgatctcagcacctgtgtctaaaatgagttcactataaatgcatagatttatctctgggttctctattctgttccactgatcagtgtgtctgttatatgccagcagcacactattttgattactatacctctgtagtataatgtaaagtcacataatgtgattccttcagttttattatttttgcttaagatagctttggttattctgggtttttgtggttccatgtaaattttggggttttttttctatttatgcagaggattgtcgttaatattttgatagagattgcattaatattgtagattgctttgagtagtacaaacattttaacaaaatgtattccaccaatccatgaacacggaatatctttcctttcgtttctgtcttcagtttctatcatcaatgttttatagtatatattgtagagatcatttattttcttgtttatgttaattcctaggtatttcattttatttggagccattgtaaatgagattatttcttgatttatttttcagaatgttcatctgttggcatgtagaaatgttttggattttgtatgtcagttttttatcctataactttactaattttttttaatcaattctaatagctctttttctggaggctttaggtttttccaaatataagattatgtcttctgcaaacaaggataatttgtctttttcctttccaatttggatgccctttaattcttttctcatctgactcctctaggtaggacttcctgtaccatgttgaataaaggtgaaattgggcctccttgtcatgttcccaatcttagaggaaagtatttcagtttttccccatttagtatgatacttatgggtcagtaattaatgacttttattatgttgaagtatgtttctcctacacccagtcttctgaggatttttattatgaaaagatgttgaattttatcaaatactttttcagcatcaattgaagtgaccaaatggtttttatctttcattctgttgatatgatgtatcacattaattgatttgcatatgctgaaccatccccacatctgtgggataaatcccatttggacatgatgaattatctttttaatgtgttgctagtattttgttgaggatttttgcatcaatattcatcagtgatattggcctatggttttcattttttgatgtgtctttgtctggttttggtatcagggtaatactggcctcatagaatgagtttggagtatttcttcctgttctatttttcaaaatagtttcagtagaattgatatgagctaatctttaaatatttgttagaattcgacagtgaagccatcaggtcctgggctttccttcctgggagacctgccccccgcccccgcacctcgcccccgaaaccaagtctcactctgttgcccaggctgtagtgcagtggcatgatctcagctcactgcaacctccaccttctgggagagttttaattatggcttttgtctcattacttgttggttagtctgttcaggttttggatttcttcctgattctgtgtttttccttgtccttaatattaccagtgagttgtgtaccttcagatgatttcttattgctcattaatgtccttttctttctgattgaagtactccctttagcatttcttgtaggatgagcatggtattgatgaaatccctcagcttttgttcatctgggaaagtctttatttctccttcatgtttgaaggatattttcaccagatatactattctagggcaaaagtttttttcccttcagcatcttaaatatgtcatgccactctctactggcctttaaggtttctactaaaaagtctcgtcaaagatattggaactccagtgtatgttatttctttcttttctcttgcttcttttaggatcctttctttatccttgacctttgggagtttaattattaaatgctttgaggtggtcttctttgggttaaatttgcttggtgttctataaccttcttgtacttggatattgatatctttccctaggttgggaagttctgtgttattatccctttgaatatttctacccctatctctttatctacttgctctttaaggccaataactcttagatttgcctttttgaggctattttctagatcctatagttgttgcttcattgttttttattcttttgtctcctctctatgcattttcaaataggctgtcttcaagctcactaattttttcttctgctttattctatttaattgtttcaatctcttagttaacttacgggattctgaattccttctctgtattatcttgaatttctttgagtctcctcaaaacatattttgaattctctttctgaatggtcacatatctctccaggattggtccctggtgccttatgtggttcatttggtttggtcatgttttcctggatcgtcttgatgcttgtagatattcattagcgtctgggcattgaagagttaggtatttattgtagtcttcacagtctgggttggtttgtatccatccttctcaggaagtctttccacatattcaaagggattgggtgttgtgatctaagccatctctgcattaggggacaccccaagcccagaagccctatggttcttgcagacttgtagaggttccactttgatgttcttgaataagatccagaagaattttctggattaccaagcagaaactcttgttcttttcttttactttatcccagacaaacagtctctctctctgttctgagccacctagacctgagagtgggttgacacaagcatccctgtggccaccaccactcggacgtgctaggtcaggccttaaactaatacagcactggatttcagccaagaaccgctgtaaccactacctggctattgccagtgttcactcaaggccctgggtctctacaatcacctgttggtgaagcaagccgtacttatgtcttttccttcagggcagtgagttctcctaggcccttggtaggtccagagatgccatctggaagccaggaactctagtcaaaacttagaagtccacctggtgatctattgtactgtggctgaattggcactcaaaccatgagacacagttcttcctagtcttcccttcactttccacagccagaggagcctcaccccttggctaccactaccataggcttacagggagtacttccaggctactgctgatgttcccataaggcccaaggcctctttattcagcttatcgtgaatgctgcttggcctgggactcacgcttgagggcagtgggctcccctctggccctgggcagatccagaaatgccatgcaagagcataatcctggaactggagaccccaatatcctgcttgtgctctatccttctgtggccaattggtatctaaggcacaagacaaagtcccctttacttttctttccacctttcctcagctggagtgtctccccatagccatcacagcttgggaatgtgctgagtctcatctgaagccagcaagtctcagagtctcatcctaggcccatggtgtactacctaagttttgctactggttattcggggaccaagggctctttagtcagtaggtgatgcgtcctgccagaactgggttcttctcttcaaggcaacagcttcccctgtggcccagggtgtgtctagaaatgtcatccatgagctaggtcctggaaaagaagcctcacgactctgaatgatgccctatcctactgtggctaagcttgtatccaagatgcaaaacaaagtcctttttactctgccctcacctctcctcaagtggaaggaaggggtctcttttgaagctgtgagctgtgcatcctagggttggggaaggggtggtgcaaccactgccttatctgatccagctgatatcttaatatatcatatgctccccgcaagtccactggctctgagcccagttcatcactaggactcacctaagacttgaagtccttgtggcctatactgcctttcaagttaattcaaggccccagagcactttatctcatagtggtgagtcttcccagaattcaagttctgacttctgggatgggcgattcccttctggctctgactggtttaaatattccctccatgggtgggagtcagcagagttcagcatagttttgctttctgctgtgacaaggcagcactgaatttaatgcagtgtctcacaagtgctgtactatccctgtctgaagcacacagattctctctccacaccatgtaggcactgcagaaggatgggtgaggggtggtgttggtgattcaagactctttcctatcctctttcagtgcttcttttaacaatatgaagttaaaaccaggtactgtgagtggtcatctgatttttcgttctttttttttattattatactttaagtttagggtacatgtttacaactttcattcttatgaaggtccttttttgtgtagatagttgtgaaattggtgttcttgttggggcatgattggtagaacattctatttggcccccttgctctgcccctcttctccatttatttttcaattgtataagtttaaagggtacaagtgcagttttgttacatggatatgatacatagtgatgaagtctgaacttttagtgtaactaaggaagttttttaaagtagggagaataacgatcatatgagaaggagcaagctatgtaaaaagcgtggcaaaagactattcttggctagtcagagtacaaaactagtgagatgggaataagcttgccttgttctaataactgatactagttcagcttagctaggacatattgagcgcagcagtgggtggagaaagcattgaggtgcaagagtggaaggggtaagatcagttaagaggctaatgaagcaatccaggcaaaaaatgatgacagctcaactagtatgttgccagtggagatggagagaaggaggtacattgatgattaagtggatgttggtgactctaaggtttctgttttgggtgactgggtgaatggaggtgccatttatagagctagagaatttgccaatagttacacaggtagtaaatgggtaaagccccataggattagacatttgtacctaacctaggtatacttttctctattgctagtattccacaggttccctgggactgaggcagcgacagaaatgcctgattcattgccctccaaagattgtgattcattgttaagggtcctagagagtgccgtctctgtctttggtagatattcttccagcagagagccataagactctttgcttatctgcaaagaccaggcatgcagtgcagcacttcatctcccctgagtttgcaatcatacaaagcaggaaacacagatataacagttcttgttaaacatactgtgttcatactgtcaagtcccagtatatttacaatggcatcacccattttcccaggctccaaatgtatcattgattcttaccattatctttttttttccccaagtcagagtctcactctgtttccaatgctggagtgcagtagcacaatctcgactcactgcagccttgctctcccaggctcaagcaattctcccaccttaacctctggagtagctgggactacaggcacatgccaccacacctggctaattttgtttatttttttgtagaaatgaggtctcactatgttgcccaggttggtctcgaacttctggactcaagtgatcctcccgcctcagcttcccaaagtggttgggattataggcatgagccattaatattctcttatgtcttgagttatttgtatttaaagttctattatttctttctaattttgaatagcctttttattcataatggctaagactatgtattgtgaaactagtgtcttgatttgacatctcaatcagctactcactgctgaaagttgcttcgcccctctttacctaaatttcccaatcttggaattttaatagtgtaaaatacttaaaatagtatccagcatatagtgaatactcaataaatgctaggttttattaatgtttttctttcaattccaatctcgctgtcacctccttaggttttgttcttatatttattattgattccttcatcaattcaatgaaaaattaatttgagctttatatgccagacaaatagattaccccagtaggctcctagtcattgtagtccaccttatacagcatgggtaaataattttaatgtacaactttgaccaagtcattcttgagttaaacagactaacttttagactaacttttagtctgttttattattgttttaaagttctctattgtcaatgcatccccattattgctcacacctaggacagactgctctcacacacacccccttgggtatatcattgccttttatgcttaagtccaaattctctttttaaaaataatcccaagtttttcatctgtcttttataataaggatcatctcataatactcttgtaaggatgttccatgctccaagacagctgaccctatatgtaccattcactgcactgccttgccaagaccttgccaccagctgcctgggttgctttcttcatctaaaacctgcccatacctccatatttgtgccttcacagtaacccagaggttattagctagccttggaacttatatcacacttacttatttttttgaaacagagtcttgctctgtcgcccaggctggagtgcagtggtgtgatctcagctcactgcaacctctgcctcccgggttcaagcaattctcatgcctcagcctcccaagtagcgggactacaggtgtgcaccatcacacccggctaatttttgtgtttttagtagagacggggtttcactatgttggccaggctggtctcgaactcctgacctcaagtgatccatgtgcctcagcctcccaaagtgctgggattacaggcatgagccaccgcacctgccatgtcacacttactatctttgtcacatagttaatatatgtgctttatattatgaattctttctctgcatatatactttgttctttaattcaaatgataagttgatggagattacaagttgtgttgtatgatgttcattggcacaaacaggagcttgttcaatgataatacaagggtaaatgcttttgaaataggaaaatgggcctcactgctgaattcctttacaataatttgtgtgttctagaaatgagctctgatcaccacagggtgtcactgccttacaagtcaaattttcctcaattggttgaggtgtatataggaattctcagaagacattcttgagagatcacaacaaaatgtatagatagcaatgcagccattgggagatgtggagatgctataaaatcacatagaacaaaaagtgaaaatttaatttacacactctaaacatcccctgaaatcctattcttcttccctctgttaacaatttgttgtatagccttccagatctttcctccttggagagagagagacagagaaggacaggcacaagatttagaaaacataaatgagatcctactctccgtgagcatgtgtgtgtgtggttgttcagtatcttttttaatttgataacatttcatttgccatcttttttgtctcattacatccagctttatctcattcttcttagcagctaatgcagctatttctgaatattgaaatgatcagtaattgatgtctttaatctttgaaatgtttgccttgatatagtccaaagctgtgattcagactggatttcattctgttgctcattatgtgaacactatacagttaattagcaaacacttgggagggttggtaggtggtgtgtagtaagttggaaaacagtttatgcaagccagattgccaccagaatttagaacagcataaaattaaatgccctaggtaatttacagggagtaaaggggaaaagaccgagagaaagagactgttagaataccaatgcatttttgtgtctgcattattgtttgtttctgattgtaaaataatacatgctcattgtagaagatgggaaacagaaaaatgtattaagaagaaagcaaacattaccctaatcctacaacccagacttatccacagttaatatttattgttgctcatatagcttatttcctttttcaaaatttttattatatgatacaacattatgattttaaagcatttaaaacagtacaaaagggtataaagtaaaaatgaaaagttctcttcccaccatccctggtcctcactttccacaaagtcattcactgttaacagtttctctcataatgtacatttaagtgtattgatattggctttattatgagtatacaaatgtatggtgtgtgatctatataccataatggggtcatactgcgttaatttttttatactactttttttccatttagctttctatcttgagcatacatatcctatatataattcaaatacaacccaaagattctgggcatggagctatttcaaaaagtttgacctgacactgccccccatgccattacatgcccttgagtttctaaccttacacaaaagacctgtagccttagctgagggccctttccaatgaatcacacattcatcctgtgtatatatggctctattttattttattttatttatttttttgagacaggtctcgctctctcctaggctggagtgcagtggcgcaatctcggctcactgcaagctccgcttcccgggttcacgccattctcctgcctcagcctcctgggtagctggaactacaggcgccctccacgacgcccagcttatttttttcatttttagtagagacggggtttcaccgtgttagccaggatgttctcaatatactgatctcatgatccgtccgcctctgcctctcaaagtgctgggattacaggcgtgagccaccgcaccggaccatatggctctattttagactgtttggtaggagatattagaggaacggatattataaagtgccaaagacctgagtttagatcccagttgtattggttgctagctatcttttaaaaataaaatgttttgaacaactttgtgatatatttttatcctttagagatgagaaaacagagaccaagccagggagaagtgattatataagatcacacagctagtttgtagtagagccggatcacacaaaggcctatttgaacaagaggctatgtgcttcccactctaacatcttggactttctttagaactcctgtaggtaacaatgtattgtattattgaaaatcaatgagagagtagatttcaagtgttcttaccacaaaaaaagataagtatataggtaatatgtatgttaattaactcgacttagccattccacaatgtatatacatctcaaaacatcatgttgtacatttatacagtgcttctcaatcaattaattaacttaaaagatttacaggcatatgccttcaaggttattgcctagccttttcactaaagccttgatacgagttatgtattctattatctttctagtatccgatcatcctctctctgattctcttttttttgtcacattccctttttaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaactgaagtccatactttattcaggtttctttagtttttacctaagatcctttttaaagaattgtttcggccaggcactgtggctcacacctgtaatcccagcactttgggaggccaagacgggcggatcacgaagtcaggagttcgagaccaacctggacaacatggtgaaaccacgtctctattaaaaatacaaaaaattagccaggcgtagtggtgggtgcctgtaatcccagcaatacttgagaggctgaggcaagagaattgcttgaacctgggaggcggaggttgcagtgagctgagatcatgccacttcactccagcctgggtgacagagcgacacacttgatctcaaaaaaaaaaaaattgtttcagcatcttgttcaggattccacattacatctaatagtcatatctccttaggatccttttgattgtgacagtttctcagactttccttgttttcagtgaccttgacacttttgagagagattttcctcaactgggatttgtcagttgtctttctcatg

SEQ ID NO: 1204 - DNA, 43012 bp, mus musculus
ttctgtccgccttccggtgtcacgcgaccgcctccccctcccacccttctctgtctacctctgggcgggactgccgggtgatgagatactcggtcggcgacggtagaacgggcgacggcgacaaccgcaatcacatccacgacggtgatcatggcagaggtgaggagcctattgcaccgccgctggccccccggacccggaagccgcctctgaggcccggggaccgagcgcccgtgtgcaggtgggctgggttgagggtaagcgggttgatgcaagtagtatctaaggtcccatcgtgtctcccatccagaatcacgcccagaataaagccaagctcatctctgagacccggaggaggttcgaagctgagtatgtgacaggtgggtactctgttccaggtattaagaaaggtgtgcagtgagcatccccaactttgctggagtgtttgtgagtgtatttgtgggaggtgttagggaccctttcgaccctcacaggaatgatgctgggcacgtctcaaaggttttcctctccatgacaagccgtgtgcactgcttcaaatggtcaagtggtgtgtcccatgctccctttaaagggttaatgtaagttggaaatcggttaagtttttagcatgccctcgtgtttatggaacttgcaggatacttgttaggcccacaacacgggtgacattgtccagtccacggttccactgctggcctttcaccagcaacactagcgaaaatgtacctggaaactgccataatactattgatgtgtacttaattgggtatacaaattccttggatattttgtttgatttggctttcatacaacccagcatgctacccacaaaataggccctccaatgctggaacaagttcttatcccaaactgtatcttgcaaagtacctatgagtccagaattgatttattggttgaacattctgtgtccagatgtcacagatacttgagttgtcaggtacttaactgaatatttaatgcttgtacagtaattttgtaaaacatacggaataacttattgtaaatatggaattaaataaggatttatatgttgcctaccttaagattgattgtaatcctaaccctgccactacatagcttacttgtctattctgagcccgttttcatatctgtgaagtgcaaataataaagttagtaggattaaattttttaaaaaaacataaaccatctagcatgtcttaaaatatagtggattctcagtgaatattttgcctcagttgtcattttggttactgtgaaaggagttaagcttctacatcttgactagtactcagcagaggttccctgcaactttaaaccatcctagattatacatcagttgatgacatagaacaaatatggaaatcggtttcaaatacttgtcagtaaatcttttcatacctccttgccaattttcttcacaccccaaactttgttccagagagttgcaaaagcacttgattcacttttcacccagagttcccatttctaataatatagctggttccaataaagagatccttcttcaattgctttctacagaaatgtaactattatagctgttaatacatggtttataatattttaagaagtaactcagaattcgacctaatgagctagtaacaccccaatagtcatttatttatgcccaagggaggaagcagaatacaggcagaaattaggcaataaacaagatcttaaaggtcatcttggggcaacctcctcatttttaaaatgaagaaagtgaggtctagagagattaagagatttgctcaaaatccctgatgttattggctaggccaggactagtgctcatgtcttctgattttcactacagtaatcttttggcaataccatgatgtcaagttagatcatgtcactctccagcttgaaacccttcagtgcctttccaactgcgtttagaataaaatcccaattctttatggtggcctgtaattcaaggccatgtgtgatctggctcttgccagcccccacccgccatcctcatctgttactactctgcttgcttagtgcagatttgaccaccgttcaaagtaagatacgtgttatatgttgcaacccaggacaaacgtgcacactcacataactgaagcaaaatttcattaaagaatacttctgaaaacatgtgactctcgatgtatttttttctatttgacttccttttaaaaaatgaaattacccacaaacttaacatcacaatttaaaatgtgacccccagttgaaaaaccacgactagccacactgccttgtgttcctcaaacagaatggggctgtttcaatttcggacttttccacttctctttgcctgggaagattttacccaggtattgcgcatggcttggtccttttttctcttcagtgtttaaatgtatccgagaggccttcactgattattaaatgtctccgtcttgtttattttctctgctttacagcccttatcgtaatctgtaattatcttgttcattggtttgtgtgtttttcatttcctccagtagagtgtacatgggttccgtagcagcctatagacattgagagtagaggccttgtgtgtcttactcacctttgtatgcccagcacagttctcaatatatacttactgaatgaatatagcaatacttaaatatatacataagaagattggtccaattttaaagatttgcatggaaaaagaaaatagaagcctttgaagaccttcttaccttaaggtttcagttgtttcctggaatatgacaacaaataaaggtagaattggaaagtgataataaaaggggtgttttgtttgtttaatttgcctgtgttttccccttagaatttgcttttagaaattaactcaggtgtttagaacatccactttccttctttttctttcaccctttctattgtcattaacaatattttgtttcagaagaggctgaaggcagacttaagcaaagttgatgtttttcctaaaggaaaatatttattttctgcaagtgtgtcacttcaagcacaaactgtattccagaaatgcttttggagttaggttcttaggaatcccaagcacatttttgtgtccatagaaactaagttaccattatgtatagatttttagctggcaaaaagaatgaagtattagcccctaattatggtatttttttccttattgtttctgagaaattccatgctgaatctcaaataagaaacgtttcccattctttcttcctctttctcatgcccaaggaaagagactaatctcttgtgacaataatttattaagttccttgagtactctttatatgcctaattctgggaagcagtgtatcagtattagagaaagagcggaggaagggtagagccccttctgaaactactacaacctagtagaggcattaaaacagagatagctattaaaattaaggcaaattgtattaagggtaatggtgctgaaatattttctgtaaaagtcaaagagagaaataacatctggctggggtgactagtttagcacagagttagaaaaaaattcattaaaaaggtggtgtttctcatgaactttggaagatggtagaactcagccaggtagagaaggtgatccaggcagattgaatagtctgaactgaggcactgaggtcaaaaggtatggggcatgttccaaagtaataggaagtctactttgataaccttaaggagggtaagcacacatggctaaatacagtgggaatatagtgtagagagccttgggcaccagagtcatgtgtttgtactttagttaatatggagagccattgagaggtttgtgtgttttgtaattaggtttgttgtctggctttacaagtatatgaattcatttaaattaatttgggtcataccaaaaatatctgaagaaacccccataaacttaccattcagagataggtgtcataacagtggatacattgtttacagtcttttttcttttttttcgagacggagtttcgctcttgttgcccaggctggagtgcaatggcgtgatcttggctccacacaacctctgcctcccgggttcaagcaattgtcctacctcagcctcctgagtagctgggattacaggcatgtgccaccatgcccagctaattttgtatttttaatagagatgcggtttctccatgttggtcaggctagtctcgaactcctgacctcaggtgatcgcctgcctcggcctcccaaagtgctgggattacaggcgtgagccaccacgcccggcctacagtcttttttctatacacttaagaaaacaaagttagaagactattctgggttgggcgcggtggctcacgcctgtaatcccagaactttgggaggccgaggcgggtggattatgaggtcaggagatcaagaccatcctggcgaacacggtgaaaccctgtctctgctaaaaatacaaaaaaaaaaaaaattagctgggcgtggtggtgggcacctgtagtcccagctactcgggaggctgaggcagaatggcgtgaacccaggaggtggagcttgcagtgagcacagatcacaccactgcactccagcctgggcgacagagcaagactccatctcaaaaaaaaaaaaaattccgtatataattttgtgtattataaaatacatttttattgacatgattttatttctccgtatttatgaagtaagcaacattgtatattgccatttaatatttggttctataaataaaagatagttttcttatcttttgtcttagatagtccctttgtggacatttagattctttccagtttcatttaatacagttttttgtgcagtagttgagattatttccttaagattcatgttcagaaactgaattattggttttaagagtgtttatattgttcaggcctttgctcatatgtgctaaacttcctccatggaagttgcaccaatattcattcctgccggcttgtaggagagtgttagtcttaccacacccttactcatatttagcgttgttatttcttaactgatggttgttttagtttgcttttgattgctaataagggtaaattattttcatgcatttacatccatttgtagtttaaacatttttttattagtatgacttttaatattggtctgggcttttcttgtttatgtcactttcacttttttcagtttttgaatatattcaaaattacccattcctttgtggtttcttctatggctattaagttaataggttggtgcgaaagtaattgtggtttttgccattaaaagtgactttctagtcttttaatttttgttttgttttggtttactattttttttcttctttttttattatactttaagttctagggtacatgtgcacaacgtgcaggtttgttacatatgtatacatgcgccatgttggtgtgccaacagtttactattttttaattttgagttttggaattctgtttatgtacaaaatgtataaaacgtgaataaaataaacactcatgtgctcactactcagccaaagaactagagcctcccagtaccttagaagcctcctgtatatacccatgcctgctattcagggaacagttttctgcatttggtgttactcattctcttacttctcattaaatttgcaacctatgacatattcctcaccagtacttcattaggttttgcctctttttgaactttatattaaagctgaatatattttttcatgatttgcttctgttgctcaaaattcagttatattctcagatatgactaatttattcctttttatggctgtgtagtagttcatagaataaatataccaattaatgggtttggggttgtttctaggtttttgtatcatgtacagtatagctatgaacatccttatacatgtctggtgcacacgtgcaagaatttgtcttgggcagtggttctcaaagttagttcaagaactggggttccttgagacgttgcaaggagtttgagaggttaaaactattttcataatactaaactaccattttcctttttcaccttcatcctctcacaagcgtatggtggcattttccagaggctgggtggcatgtgatgatgacattgttctgatggctgatagactgtgtgctttatgttctcatgtctaattctttttctcaattttcatacctaatacagtaactagcaataaatataacccatatcaacaaagaaacttttggggggtctgcaattatttttaagagtgtaaaaggtgtcctgagaccaaaacgtttgagaactgctgctctagggtttgtttccaccagtaaaatgagtaggtggtagaataggcacattgtttcacattcaacttcagtaggtaatgctgaactgtttcccaaagtgattgtaccagttttcattttaaccagcagtatttgggcatccttgtttttctacatcctaaaaataggcactgtaacttaaaaaaaaattgcccatctgatgggcatgttgggagatctcattgtggttttaatgcctttgaataccagtgagattgagctttttttttcatacctttatgggacctttggtttctgcttctgtgaaaattactccttccaactcttcttggcccttatttcttccatgtaaacttcagaatcagcttatgtttctgcaaaacaaaacaaaaaccacttttgttgggatttcagtggtattatgttaaatcagaatataatttcatggaagttgacattatcatggttgagtctttttatccaagaacctggtatatatttgtatctgctaaagtcttccttgttgaaagatttatcattttccttatagtggttaacacagtcttttgttatatttcttcccaaatactgtatgtgttttatttttgttgttgttatttaaatggtatgtcttaatatatattttctaaatgatggttgctggtttatgggaaatatatatgacttttttccattaatattgaatttactcttataaattctgataatttacctgggatttttttatgtacataataaccaccttgaaatattgattgttttctttctaactttccaattcttaaatctttcaatacttttcctttactacattggctggaacttttataacactgttgaatagaaccagtgataatagcctacttatcttattcctaatgatagaaagatagctctgaacatgtcaccattaagtatgatctttgtatataccctttatcaaagtgaagacattttcttccacttttggtttgctagtttgggttttttgtttgttttgtttagttcccatcatgattgatgattgagttttaccaaatgcagtttcttcatctgttgcacacatttattatatttgatgacattttgatttggtttttctcctttactgtgttaatatggtagattacattgattaggtttttaaaataaattgctaaattctgtttactaatagtttaagaattttacatttgtattcttgaattggcctataattttcctttctagtgtttttcttgtgcaatattgacatcaagattatctaagcttcagagtgagtgttacctcttttctattccctataagatatattgattgtttagcacaacctaattccccaaattcaccactcccccaatttgttattgttgttttatatatcagtgtttgtttatctaccatatatttactactattttgatttaccctttcttcctgagtttcagatcttgtatcctgggtcattattgtttcatctaaagtataacctttagatttctcctggtgggatctgttggtagtaaactttcttggtcttgaaaatagctttattttgtccttttttttttttaattaagcaattagctttgaggaatgccttcattttgttaggctgaaggagacaaagtggttagagaagtaggagaaccaggaaactttattattgtagataacaaaaaaaggagaatttcaaggacaggaagataagcagtaaatggaaaaaactcctgtagggtaaagggaacatataacagggattgtccttattgattactctttcttgaaaggaaaatgacatttaaaatgtaactatactactggagagtttgcctatgtgtctagactatgaaccactcagggaccagctcaggctccactcatctttgcatctgcaatacctggctcttttaggctagcatgtggcaggtgatcagagattagtgctcataggtaatgagttattattatttccaagtgaggaagcctttaaaagattgataaataaacagacacacttggatttgcttaaattctactccatcattaacattctcaagatcaacctttttaaagttgtcatcatcagaataagaggaaaagatcttaagaggttatcagatgaatggataaagaaaatgtggtatatatgcaactataaaaaatgatgagttcatatcctttgtagggacatggatgaagctggaaaccatcattctgagcaaactatggcaaggacagaaaaccaaacaccgcatgttctcactcataggtgggaattgaacaatgagaacacttggacacagggtggggaacatcacacaccagggcctggcatggggtgggggaaggggggagggatagcattaggagatatacctaatgtaaatgacgagttaatgggtgcagcataataaaaaagaaaagaaagaaaatgtggtatatatatacagtggaatactattcagccttttaaaaagaaggaaagcctatcatttgtagcaatttgggtgaacttggaggacatggtaagtgaaataagtgaaataaaccaggcccagaaagacaaataccacatgatctcacataaatgttaatgttttagatttttaacattgaactcacgcaagtagtgaatagaatgtcagttaccaggggctggaggggtgagggttgaggcgggagattcaagagatatgagtcaaaggaaacaaaatttcaatcagacaggaggaataagttccagagatacattgtacaacatggagactatagtaaatacaatgtattacatacttgaaaattgctaagagtgtagattttaagtgttctcagtacaaaaataagtatgtgaagtaatgcatgtcagttagcttgattttgctattccacagtatataaacatcatgttgtataccataaatataatttttgtcaattaaattaattttttaaaaagttaccaatttttgtccttattacatatctaaaaatatcaagactgctttggagaatatcagattgtaacttcacattggagaccaaatttggtaaacctatttatttttgaatgtttcttttcagtaatgactttttgcaatgcctgatgaatgttcttgtttttttctttttcttttttttttttttactcatctctttaagttgtttatacctgttcttcatatatcctcattctgaatggttagggaaatgtgcagctctaaagaatctgttactaggtgctgggcgctgtggctcacgcctggaatcccagcactttgggaggccaaggcgggtggatcacaaggtcagaagttcaagaccagcctggccaagatggtgaaaccccatctctactaaaaatacaaaaattagccggtcgtggtggtgggtgcctgtaatcccagcaactcgggaggctgaggcagaggattgcttgaacccgggaggcggaggttgcagtgagccaagatcgtgccactgaactccagcctgggcaacagagtgagactccatctcgaaaaaaaaaaagagtctgttactagaatactgtcatttctaagatgtgaatttgtttttagtcattgtcatttggaaagcttgcatgagaggagtggtctgtttaccaaatctactgtgtgctcttgatagtagtactctatcatatgaatgtttttcattactgaaaatttaccctctaacaagaattttggtttgataagatctctaggagattgagtagtgctcacagaaattcctaaaggattttttcttcctgtagccattttgcaaggaataggaggacaaaaatttgctacatttcaatcaaaactagtttaagctgaacttgtagtgactataaagatttggcatatatgtgtagaattttctttgatattagatactagtacttactagctgggccatgatttgcagaagcttttctttacccattatactgctatatattcacaactgacataggacattcacagactattttaaagtttttctacaagtacttactctatacccagatcattggaggaagaaaacagataaaaatgtgtaaggaaaaataaaaggcatgagaaacacaatatacatttaatcaaacttccagaaggaaaaaaagagtgatattagaagaaataatcattgacagttacccagaatttataaaagatatcaaatcctcagattaaagaaccataagaaaatctgagcatcatagggaaaaagaaattaatctcaatgcttattttagtgaaaccaaaaaacaccaaggacagagaaaatctaacaacccaaagagaaatgacacatccacaaagaaacaaaaatcagactgatacttgatttctcatcagtaacagtattgccaggaaacagtgaaataattttctgaaagtgctgagggaaataactgctcacttagaacatttattcaaaagtgaaggtaaaactttttaggcatgcaaagattgaccattgctggaaaaaaaaaaactacttgtctacttcactaataagtaaatagtacaccaaaggaagcagagggatgcaagaagtaatgaaaagcaaagaaatgggtaggcaaattagtaaataaaaaatctaactgtggatagtaagaaaaaacaaataataataagagtagaagaaatggaggtaaagtattacaaggaactttcagaatgaggatagagatactaactgcagattttgttgttttcagtgtgaatacttaaaataagggtaatcattgaaagatagaaataaaatgtttgacttccacaccagtggaggaatgaaaaggggaatggaggaaaagtcctctccaggaagaagcagaaaaggagaaaaaaagcagcttggttaccagaaaacacagaggaagacagcagaaagaattccaactttatcaatagttactataaatataaactgatttctgcatattagatatcagattagatttttaaagatcttaactgcatgcagtctaaaagagactaacctaaaataaattaatgtagaaaggttgaaaatagatggaaaaagatatacaaaacaaatattaaccaaaagtaatgttgtttcagcagtactttaggtaaaatgttacttagggtgaaagacattaatacatataaaaagggatactatttgtgataaaaggaaccgtaaaagggtataacacctaggaactaacaacataaaaaactacctaaccatataaccttaaaatactcaaagcaaaaagcacccagaatcataaggggaactcaagaaatctacaaacatgttgaatgattttaacaaccctctttcagaaatagaactagcaggcaagaaatatttaagatttagaagattttaacactacaatgagcaaatttgattatacatatatatgtatgtgtgtatgtatatgagtatatagactctcctgcccaactagtacagaatatatactttttgaatatatatttgtactttcagagcttttgcaaacattcaccacatactaagtcataaagggggtctcagaaaattccaaagaagctacatcatacagaccatgcccatacattattaagcaactacatcagaagtcacaataataggtacttaaaaacatgtcatatgataggaaactagaataacacacctctaaataatccatggattaccaacttctcagcaatggtgtaaattcttctgctaaataacccgtgggttaaagaggacatcacattggaaattccagagtacttaaagttaagtgtatcttctaaaaacctacagcaaatgtgatgtttaattggggaactttagaataattcctataaagtcaggaaaaagacaatgatttctgctattatttcaataactctacattatataggataacttagttatgaacgtggcaggaaaatatgaggtataaagtttgccaatcttgtcataggcttatgataacaacacaaaatcctctaaactgcctaatctagcaaagaaatgtaaggcttttatgggaagattaagggtaacttcagctttatctatgacattctagtccttttattaaaaaaaaaactgaagcgaataacttaatatttgttaattttgggttacagctacataaatatttgttaacattattttctattctataattttttaacttttcaaaagggaaggaaataaaacagtttattagtgaagttctgggtcctcaatgaactcaagatctactaggggatagacttgtacatggctaatcattcagtaacaaagatttagcatgtacttactgtgtattgggcagagttggagggagcagggtgtgacttttcaaagtccctgacttcatggagcttattagaggagacagcatcagtccgactcctctcatgccatcccctatttgaggagctcctctcaaaatgactgactcttactattatcctattagttttgatgaaattgggtttacattctcccatttgaccaaaatgagccaagggaatgattgtagatagtgtgcttatgcgaagaccttgaggcagagtctgtaatatacaggaatagaccaaggtccattatatctaattaacctggataactggctggtgactgatgaggacctggagaacagttttgaaagtttagctttgtttgttcaagtgtactaaggaatccagctcttgaaggataagaactgaagcagaaagcacctcccctttttagagtagaccagagatcagcaaagtcttgtttttgtatgacccttgagccgagccttttaaagggttgttacatacacacacatacacacacacacacacacatgcacgcacacacacgagagagagagagagagagagagagaaatcagcaacagagaatataataagaatataatatggccctcagagtcttagatatttgccatctgggcctatacagaataagtttgccagctcctgcagtagaacaacagttctcaaagtgtggtccctgaccagcagcatcagcagtatgtaggaactggttacaaataccaattgtcagatcccacccagaattagacagtctaggggtggggcccagtaatttcagttttaataagccttcctaatcattctgatatgtgctgaagttgaagaatcactgctataaaccaatggcttaatcccattataaaagattacctgtctctcagtctcaccagtttcacaagaaagtggagattcagaataggttgtggccaactagcagagaataatcttgaaggaatattttgttcttttgtcttgatcacacccattactgacatttatgcagtccagctaatagaaatagtccatccaatacgaatgctctcttaatgccccagaaggactttcagtggatctatgctcagagtcatggagaaataagagatcctaagatgttttaaactactataatgatctagagttatatgtttgctgctttggaatattaactgttctctagttttcgttattagaatactttatattttttcaacctttatctgaaatttaggcacatttgtaacaacaatgtacttccaagattttccttactggtaaactaataggtaaatttaaatttagtcttcttttcatagttagcattctatcgtatgttgatggaaagtcatttgtatagtgtttaagtttttcagtgttcttgatctttctgagactgtaggtagacagacctcattttcattttacagagaagaatagaaagcctagagtgacttgcttagcttcactatacatagtggcatgggtcttccaagtccatcattctactctatatcctgaatgtggccagaaattttctcacattgttagccttaaaacacagtttcagacctgttggtaacatcactggccaacaaatgcaagagaaaaaaagaaaagttaataataaagtttgctattttacaagtaagagctatagtttctttatcttacaatttttaaaaaattttatttttttatttaaaaaattgtgtgtgagagagaaacagtgagtgagagagaacacacatatgcatgtgtatggagagacatgaaaagctgagacaggtcatctttaccttggaatatttaatactgtgtgttcctagagacatatcaccattgtcatgtatctttagttctttctctcccaaataatggactttacaatttgtttggtggtaatacacttgtataaatagaagaacaatttacagagcaaaattcatattagaacaaataaatagtagaaagggccaatgaaccatagggtgctgatagttcattaagaaggtttcttcatgaaggattggctgaaattagctattttaaagaaatacagagatgaggcttaaaaatccaccacttggaattactgttgtttttgatgtggttttcactggtattatgagacaagctatcatttgtgtatgaggacaagtattgggagaatatatacacacacacgcacacacacacacacacacacacacacacacacacacacacacctttttataaaactgaacccttctgatatggtttggctctctccccacccaaatctcatcttgaattataactcccacaattcccatgtgttgtgggagaaacctggtgggaggtgattgaattatgggggcaggtctttcctgcgctgttctcatgatagtgaatgagtctcacgagatctggtcgttttaaaaatgggagtttccctgcacaacctctctctttgcttgccaccatccatgtaagacatgacttgctcctccttgccttctgccatggttgtgaggcctccctagccatgtggaactgtaagtccattaaacctctttttctttccagtctcaggtatgtctttatcagcagctattatgaaaacagactaacacagtaaatatatatatctatcctattagttctgtccctctatagaaccctgaataatacaccttcttaccctcatctctacattttaattgttgataggtaaagtttttcaaaaaaatgtcctaggggtgtgtgtgtgtgtgtgtgtgtttgtgtgcatgcatgtgtgtttttatatctttagataatcttttgggtgtacatctttagcatctttctgtaacatcttgtcttagtccgttctgtgatgctgtaacaaaatacctgaaatttcatcagtcttagtccgtttgtcttgctataaaggaatacctgaggctgagtgatttataaagaacagaacagggtaatttatgaagaacagaaatttattttctcagttttggaggctgggaagtctccgatcaaggtgccagtacttggtgtctagtaagggccttcttgctgtgtcctcctgtgacagcaagtggaagggcaagaggaggacactgccgcatgaagcctcttttataagggccataatgccattcatgagggaggaacccttatggcctaatcacctcttaaaggccctactcttaatcctgtcacattggcaacacctgaatttaggagaggcttgcttcaaaccatagcacatctgaacttacccaaggactggttttctgaaatttccaatcgcttgagggctcagttgtctgagggctgtgtgtgaaagcaacaaattgtgttgataaaagcacaattatttatcacccttggccttgtgcttccaggctatgtttttcttaccttcaatgctcagtttattctgtttctttctctgcctcttttatctttacctccctcacctttctttcctctgtgtctcattctatctgtctctccccctctcttccccctcaaccctctcctctgtcccattgtcctctgtcgtcttctgcctctacttttctcctgcctctctcccccaacccccatgtgcctagctgtcaaatctttgtcttctcttttctttcccctactctgatttcatttctatttgtctaggggtaaatggtcaacaactagcatgttatatgtaagaacattaataaaaatcattttaatataaatggggctttctaatttcaaagatcaacattgctgaaagctatcaaagagccgtgggctttaaatttcttagtaatggacattcatttgtttatggtattccctagtgatggtactagcagtggtggtaaaaatgacaacaacaacaatagtgttttattcttcttaatatggctaatatttactgagtttttaccacttgccatatattgttctaagtaattggtttttagaatatatctggggatcctaggagatgcccaagactttcagaaagctatgaggtcaaaactattttcataataatgctaagatatcatttgcctttttcactttctttacatttgcactgattacacagaagcaatgatgtgtaatcagtactggctgcttcgcccaaatcaaggcaggtagtcattgtagtcctcattgtcagcactcttagtttaaaaaaaaaaagacaattttattttagaaagtccctgatgaaacagtaaattgtattaagttttgacccttgagtacatgtcctttcaatgttctgtgtgacaaaatcgggaagtgtgcataaaacacttctgcatgctaagtatgtttgagttgccagctgaattagtcacctgtttcataggccaccctttttacttgaaaaaaattgtaaaaaatgtgttttgaatactgatgaattttcaaatagcagagctaaacaacaatctctaagattacctaccacagaaccactcattttatagattagaaaaatacaacccagctattaaaagccatatccaaagcagcactcttacaaatgcatgatttatggcctcttcttatattttatagtgctttaaatttccactaaatttagtgctttaaatatataaaattagtgctttaaatatatactttttcatccgatcctcacacagcattgtgagtatataaaacagcttaaagataaggaaattgagactcaaagaagacaattctctgaatgcagtctatattttcctggcctttcagctattatctctgaggacctgaaataaggcagtgcaaatcaagaagagataggatccataaaacctggcaactaactagatgcagaagaaaaggaaatgaaggagccagggaatttcctgaagttgttttgctttgttttgttttcttttgttttttgtatgaaccttaggagggtatgacaactgagaaaaaaatgagaaggaatagattccatcaacagatgtttatggaaggccttttcattggcactactgtaatctgctttggaggatgctcagatgtatagactatctgtctctactgtctatttgggaaatatgtcttccgtgctagtaactgtatttcaaggtaaaagtggtaagcaccttaagaaaagcttagttcaagttccataaaagtaattgcttttgcaccaacctaatacttctggactcagggaaaattttatggaatagggagcatttgaaaggagacttgcagaatggtagcatttggatgtgcagagacaaggaaggttcagttacagaataataaagcagggcaaggaaggaggaatgtctgctatacaagttagtgggaatatagtgtgtgtgtgagcaactgatgagaaattattgttattagaaataattattccaagaaattattgaaaatgtgttggccagagtctgaaaatagtaaataccgtaatatggcatacatgatcagttttccatcggtacttagttaattttttttttactgttttttattgttgttgttttttctttttttgtctttatttttatatttaatttatttatttatttttttttttagacagagtctcactctgtcaccaggctggagtgcagtggcacaatctcagctcactgcaacctccacctcccgggttcaagcgattctcttgcctcagccaccctggtagctgagactacagggtgcgccaccacgcccagctaatttttgtatttttagtagagacggggtttctccatgttgcccaggctggtctcaaattcctgacctcaggtgatccgcctgcctcagcctcccaaagtgctgggattacaggcatgagccaccacacctggcctacttaatttttttttaatgacacttgccaaacaaatgtctttttaaagcacaacttagttatttctttacatatgaaatttcttcatttttcattgacttaagaatttcaagttcagataacataattaatcttcccagatgttggtgtatagttttagagagggctataccaaatactttactctggtgtaatttttaacatctgtagtggcttacttaaacctgcagtctttagataacgcattctcctcacacttgggaattccatcagtcttagtccatttgtgttgctataaaggaatacctgaggctgagtgatttataaagaaaagaggtttatttggcccatggttctgcaggctatacaagaagtatggtgtcaatatctgcttctgatcaggacctcaggaagattccactcatgacgtaagatgaaggaaagcaggcatcacatggtgagagagaaaaggcaagagagaaaggaggaggtgccaggctcttttcaacaatcagttcgtgcgggaactaagagcaagaattcagtcgttgtcatgagaatgataccaaactactcttgaggagtcctccccatgacccaaacacctcccaccagaccccacctccaacactgggcatcagatttcaacaagagacttgggggaaccaagcaaaccatatccaaacaatagcaccatcaatcttttaaatggcgcttttatctgaactacatccctgagtctatcctcaaatagcttaactttgtcttggaagtctttcttctcctttgccattagtggttatttttcactgcagaattaatctgacttggatgtttattactgttttttccctagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatggtaagctgttcaatttaaccttgactgtaatatatactgtataaatggtattgttttacatttatctaatcatgtatttgcacatattcctagcagtcatcataaacaccagaatataattatttataaagacccagtaatattttcaaaggaacagcttataagtcttttaagtgggatcattcataaggaaatcagatcaccagagagcagaatcacactcagattcttcattcacagcagagtttcctaatctgtgtttaattcagtaccattaagcaatagcaagacagtatctttgctactaggcctagaaataaggagatactgtccatttttctcagttgttgcctatgcctttctctgtccccacagttccttgtgctaataggttaataggtacgccatatagaattgttaaatgaatgagagtcaccccaaaaatgcaagcttatccccaaggaagcctatcacagtcttctctgtatattgtttttatttttgtgggtacatagtagatgtacatattttggggtacatgcagccttaacttcttaatttctaagtctgctactagatagaatttttttccaaaaatgagagtttcaagtcttggagttttataatggtcttcaagtatatgaagacctgttagttctctccaccaaaaaattgaacaagaagaaactggcataacttctgttttcagttaggcataaagcagaattttctgtccttgaggattataacctctgaagtgacttcaatctgaagacttaacacaaaatagtcaacaataaatccagagcagatactctcctcactcttcatgcttgcagaaggaatccctgaaagggggattagtaaaaaataatgtgattggaaatttaacaaatgtaggtaatttcaacagtgaagcatttattaaccaaagaaagaaatataaatctgatatttttaaacgatttaagtactgaataaatatttaaactcaacaatgtttgttttcttacacagaattgctatttcctggtgaaaaatagcagagatatggtaaaaggggatggggaaagataaatctttgaaaggtcttaaggtactgctggtgaatgaaacaaaaacattggcatttgctgccttgctatgttggtccttagcctccccaaaaactggagaggcactctgtttgttcctcctgctgaagttcaagttctcacattttttgttttcttttcttatcttctcttttctttctttctttattttattttgaggcagggtcttgctctgtcacccaggctggaatgcagtgttgtgatcatagctcactgcagccttcaatgcctgggctcaggtgagcctcccacctcagcctcctgagtagctgggacgacaggcatgtgctcccatgcctggctaatatttatttattgattgatttttttttttttttttttgagatggaatctggctctgtcacccaggctggagtgcatggcgtgatctcggctcactacaagctcagcctcctgagtgcacgccattctcctgcctcaacctcccaagtagctgggactacaggcgcccaccaccaagcctggctaattttttatatttttagcagagacagggtttcactgtgttagccaggatggtctcgatctcctgacctcgtgatctgccctcctcagcctcccaaagttctggggttacaggcgtgagccaccacacccagcctaatttttatatttttatctttgtagagaggttgtctcactgtgttgcccaggctggtctcgaactcctggcctcaaatgatactcccgtgttggcctcccaaagtgctgggattacatgagtcaccatgcctggccatttttcttgaagtattttccactttcctaaaggtttttaaatgcattaaagtctactagataacaaacttaatattagattggtgcaaaagtaattgcagcatttgccattatgtttaactgcaaataccacagttacttttgcatgaacctaatagaaaaataccattttactaaagaaaccaaagtgatttttttctactaattctgaggctgcaatgtggatatttactagaatgttctcttgaaactctgacagtgatatttgtttgcaagtcattatgtgaaacaatcaaaatgtggaaatgtatccacataaataatgacctgtcaagggaaatggagtttgtccattttggtcccctgtgtcattatttagtttgtttgcttggtaggaagcaccactttatattgccagagatttttttttgaatgtttgggtacattatatcatttttaaagctcagaactactacataacattatctttacattatgagttttatttttaaacccctaaattacaactactgatcaaagcttaccactttttagaccttaatgaatcctccattcccagatggttattggaaattggtgttatttatctccatggttatgacaaagaaggtaacaaattgtgtaagtatatttaatttatgttctggcttttcaagattttgagattgagatatctatgtcaactgaattaagaattggcagaactttctccatctgtagcactcctcaggtcttctgcaatgagggattggcaggaccatttttacagagtgttagatacttagtagctgtgcatactgtttgcattataataaagtaggcaataaaggcaaaaaataaatgctgcatcctacagcataaacaaagttatttaattcagagtcattatcttctttctaatctgactgtgatattaaaactcgtcttagtatttttatggagaatttttttgacagtcgctaaaggttgctaaataggccttttccttttcgagtctcccataatctcactctagctttttctgaaatgtgtattataatgaaaggaacagtaacaatcatctcttttgttccaatgactcccctgttatacctctctcccacttgccccaaatccagcctggttttataccagggatgcaacttggcaggcatgttcaagccccatactgaacagatgtcctgcactcatcttcactcctccatagcatgtggtccgtctctgagcaatactctttttgcattttcctcttactgccacctcctccttttcaaccttttttttctcatttttcttcttccacctgtcccttaaaggtgtttcccaggctttattcctttcttgcttcttttactttacagctgatacagtctccttgggtgatcaatcacgagcatcttggcagctttagctacctcccccggcacagtattgaccccacaccatccccaggccacatgcacatacctagctacccactgactgccccctcctgactgtcagcagcctttagcacaacacactactgaacatccatgcctgtccacttgctcactttctgtattgcccacctcaggcccactcattggctcttcctctaatatagcttcaatttggccttttatccatcctcaccagctacttcctcaattcagtttctaactactacacctttgccccagtcccttcccaggtcataacctggtgggtttccttctctgcctcctccagtctgccctctgtgctattgcccgaaaggtgttctaaaataggaaaatgaaagtgccctagagtttcattcacagtccttcaagtccagttctttcttatttagcttctcctctcaccactcatcacatttcatcttagctaccaccacctgaacagtttaccgtgctccacacacacgcacggcactggctcatgcctccatcgccctgtgtcagtatctttcctctggacggaacattttttccagtgctcgacaaaagcaatgactttcttttttgttaagcacaatgcagagcacatttagattattatcaaatagtgtttgttcacctgtattttcttttccctcttacaagtgaaatttgtttatttcctaagggaaacagtctatctctctgctactcttcaatttaaggcacccaagtgcaacagtttctcattgaaaataagaaagagatgtttttgatctaagaaataaaatgaattgtaaatgaaaaatgtcaagggaaaggcaatatatatgtataataatattataatgccataagtcttgttcttatttttatcttctgcttaaagtctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgtaagcattttttcattcattccaaatcagtgtttatcatggcttcctccctttctcctgtccttgctgccaaccacatattgctgtaaaattgaggtaactaacttatattagggatttattttttcaccttgcagtgtgagtgtagtcaaacatggaatagggtttgcagagaattaaatttgtttctgtatttggcgttgaaactgtcgatttcctagaaatgttccttgtctgagacacaggatggagaggtagcatgtcgaggctggcaaggtatgaatcgatgtgataactgtgaactttgatatcaaagctaatatcctatagcacctgccccggtgtgtgccacatagtaatatattcaggaaatatcaagtaaggtaatataccatctcgaatttgttatattcataccatgttttacagttgcaagatgttcacatgagttttgcacatataacactttgtgattttattgagtgtttttgtttgcttgtttggatttgttttctatctgtttgatttggttagctttggaaaccagttttcttcaggtgattttgccaagcttgaaaaataagtaaaacctacctgtctttaatttgggtccttgtgaccttagtgatacctacaaacccttcagcagcaattgagatcacttggcacatttattctaactactgtctcttatatttaatctgtggctaattctgatagcagtaatgtcgtattcacaaacgtgctcagggcagtgttgaaatctttttggaattccatttggcaaattatgttaagaaccttaaagtgtttgtatttatattctttgcctggtaaccaacttctggaaatctattctaaagaaataatcctgagtacagaaaaagcatcatacatcaaaatattttcccagtgtcatttaaagtaatgaaaaattagaaaaaaatataaatgttcaacatgatgaaatggcaaattatggtatatctagttagttgatggagtatacatatagctatgtaaaatggtgtttttaaggaatttatagtaatattggagagaacacttttttctgagatgaaaaaagctgtatgattatacatactataatatgtatgtattctataccatggtgatacatagcccaacaaaggaaactgtagacataacacaaaaccagctagagagaactgctaacaagagctttcttgcagtggtaggaccacaaatttttttcatgtttctatttctctttttatttttcaaggatccgatgccctggagttttccaacctagtttccatgtcagtggttttaaattagagaaagtaaattattttatatccaaaatcaaaatcaatttgcctagataaataaatattccataaaaataaatcctgattcttttgtcctttggatatgatagtttcctaattattaacccagaatcatgaagaataaatgttaatatttttgttgccaagtataaggacagagaattgacttgaactgttttattttttcaagctacttatatctcaccatctttaatttgtaaataaggtgtatttgcactactaagtatttaagtcattattgttttaaaatacttgaatcttactgaataatttattttcataaatgaccctttcatgagtcacaaagaatttaagtgagcttataaacatgtcacaaagaatttaggtgagcttataaatttcaaggcaaaaaataagaaaatcatttgttagagttgggacaccagtttggctctaagctttcagctgcctgcctgaaagaaatgcaatcatttaaaattattcagcggccatccttcacaaccagtgtcttagaagtatatccattcctaatacttgaactagaaagtctttcatgggtcctcaaaaggacgttttacaagataataacagcctcctcgaaaacatccttatagaatgctgagcaatagggttgatggagctatttcttgtagtccccattaatagaatacaccagtgacatcttatcatatccacttgaattagcagtaactcacgattttacgaagaaggatattcaattaaataaatgatagaaacaagaatgttattccaagactatttagacaaagtctctgggggccataaattctagactaggtaaccacatttttatataactggttcttttcagctattttctttgactgttacttaactgccaattatgaaaactccatgcacagtggctataatgattagttacaaaggtattattatatatatatatacacacaaaggtattttatatatatatattatatacatacacacacacacacacacacacacacacacacacacacacaaaggtattattatatatatacccataacaaatacttaagatagttaaggatgcttacttttagtttactgcaattaaagatgctgcaactaacattccagggatgaatttatagacacttatctctaggaaaacccacctttccagtaattgtgatggatttcagtttgcttggttgtatctttcatcccacagtctttataagatggccaatcagaattagtgaatcagtatgtggccatggagtgaaatgactcatggaaataaccttaatgacctaatttcctgttgctgtgctcaaagcagtagaaccaaccagatagctatgtttgtagtctcccagaaatcagaatcagtgaacaacactggaatataaactaaaaaactaattctaggtctctaaataaaatttaaaaagccagaaatggagtagatacagcaggccaatgtgattagattaagtattgtgtttaaaaaaggttgataaaatatattttattgacactattatgtggtgtaaaaattaggattaaaaagcaaatatatgagaatttacatacatgtgtattattatcccaagtagtctgattataaactgtatacttgtttcaataattctttagttattcaacagatttttagaatttctctatggagattgcttttagatccattttatgccctgttgccttagtagcctgaagtgtgtaactagtttgaggtaatgtgaataattttaaaacatcactaagcatctggtttcttcaagtcagttttagggctgattattataaatagcttaatgacctaaaaccttaatccttgagaatatagatatttacatatgagcttactttttaaagaatttaataattgtctcacttgtatttaataatttatcacctttagaaatgtgcaattttaagttctctaatgtggacagtcttaaagatttaatctttattttaggacatggactttgtacgctttatcatcaactgctttaaggtttattaccctaaatacctctgtaagtaacttactcctttataaaaaatataacatattgaaactgtagacaatgtctgagaattgtggagccttatgttattatagactttcatacctgaaactttgttttctgatgaagaattttaaatgtgttcatagacattattgtaacacatacagaggaaagtttttcataagtattcattgtccttcacagttaattttaagagtttaagttctaaactatatatatggcatcctataacacacacacccactcacacacataggtacataaaagcatacatttatttcaaaattatctcatttttactaatatttcaatttagaaattcatttcaaatagtatttattatatgaaacttcttgcatacaagaacagataagcagtattgatagagtacactgtataataagcaatattgatatataaagtacactgttaccaactgctacttaaaaattgtcattaagaaaatacttgactagaaggtactacatttgaatctggcatttggagtttgtttgttttttattgtgactattccattaattacctgaatgaagaactcctaaaccttatatagtccattttttacttgttgaatttgtatgatgggttcaccctagggaagccgagatgccaactcacataaacagtcaagtatatttaaccccaatggtttaaaagtgaaaagacagcagagaggcaacagggatgtcagaaaatgggaatttacagatctgcctgagcgtactcctagaaaacagcaaattgggtcttttgggactcgtgactcaggtgactttagcataaaatccctaaattatcttaatttggcatgttaattttattgttaatgtgaagtgaggaatagacaaaaagcataatggatatcaagagtcagtgccacccctagctgtatactctcatcttttcagagagagtattcatgaatatttttaggtaaaaagaatgatcaatagtgtccagtttggggaacctgtactatcttctgttccttatggatttttcctgtatctggcatgtaccctgattccttaaggcctccagagcagtgccagtcattggtcagtagggaatcactaccccatagttttagtttgttgctcttatggacaaaatgaaaaaatatccacttgatcattgaaatatctaaaggagtttgtgaagagccacttatcagtagtataaatattattattactttgtaaaatacatctgagattcttttgagagaactattaaaaagttaatagatctatataaagatgagttgtaatactattcatcttaactagagattttatatatatatatatacacacacacatatatatatattctacctacataatatagttttgcagacattgaatttcgtggaatcttaattgattatgcttcaaaatctgtcatgaagaataactattatatcttaaaatcttgagtccacattattttaagcatatcccagacgaagactgaggtattaagcaccagggtgcctctttacagatgcctttttccttatatgtactttacttgtcctacattaatgcaacaactctaagaggttctctgctcagagaagagtgaaattacattttgattcctctggaatagaggaatgaattgaatctcaaaaatcttctttgcagtttctggttctttctcacagttgtctcagttgttaatagggctgtttagtatcttcaactcagtgtgtaaataatacttatgcatactttggaattattagcttcctggagctcatgatataaagtagaaataatttttgtttctgaaaacgtagtgatgtattaaaaggggagggggcaactgtgagactggtttaacaatagaatctctagaaaattgtaattgaaaccataaattagacctggaaatgattttaaagttcagtggcttcagcactactttgacatgccacatccaaaaactccatttatccacttaactgttttcttttgtacctccctgcaaacaacaaaagcagtgagtgacaaaagaataggctgtttaccagaggacagtgacagtgcactattgatttcccacaagtcttcctcctgggctggcacctcaccattgtgacatgctagttcagttccagcaccacatggaatactattcatgatactatacacttcactgaattagagctcagacaacaagctcagtttttacttaaatttagatgaccagttttttctaggctggtatgagtgatattattatagaggtactgattcacattcaatgaattttttttcatctttcagcaaaaatagtgatctttgatatgccttggttaatgaatggtgagtatatttatactttcttaaaacaaaatgtctaatttcctttactttgccgatttagccatatttctacaattgtttaaaataatgtttatattgtcctttgcatgctctcttaagagactggagctagaacactcaaaggctattcctaagcaaacagggctaaaattttatacccaggatctgggggcacccattagtcttctttaaaaacagccttgccaggcatggtgttgcacggctatagtcctagctactcaggaggctgaggcaggaggatcacttgaacccatgagtttgaggccagcctgggcaacataatgatacccatctcttaaaaaaaaaaaaaaattaacaacagcctcaaatattcaaccattaaggtaatactctagtcagaagcctcaatttgtcatgcacagataaggtatgtcacagaacacaggccttgtctaggtttctcatgggcttcaggtgttgagaaagaaggtggaatcagtctgaaactcaccccaaatcactgtagtgacatgacccttttgacagtcatgatatattttttggtaaaatttttttgaaaaagccattgattgataaactgtcttgaccaactttaaaattactgtaaattgaatgttattttcagaatgtacattctcatttgtgtttgcaaaagtcagttgttacatagaaagcaatagagaaaatcaacaaatccaaaatttggttctttggaaaatgcaacacaattgacaaacctttagctaataaagaagaaaaggaaagactcaaagtattaaaatctgtaatgaaagaagggacattactattgaccttaaagaaataaaaaggactatagggagatactgtgaatgattatatgcaaagaaattagataacctacatgaagtgaacaaattcttagaaagacacaaactactgaaactaattcaagaagaatcagaatagaaatataaaaaaggaagttgaattagtaatcaaaaaaaacttcccacgaagaaaagcccaggcccagatggcttcactggtaaattatgtgaaatatttaaagaagaatcaacatgaatccttcacaaattcttccaagaaatagaagaagagggaatactttccaacttattttatgaggcaagtataaccataataccaaacatcacaggaaaagaaaactacagactggtattccttatgaaaatagatgcaacagccctcaacgaagtactagcaaattgaatccagcagcatataaaaaggattatacaccatgaccaagtgggctcaacatatgaaaatcaactaatgtaatctaccatattaatataatgaaggggaaaattatgtgatcatctcaagagacacagaaaaagcatttgacaaaatctagtaccctctcatgataaaagtactcaacaaactagcaacgtaaggtgcaaagagttgaaacaactaccaagttagaccacagtagtccacacaagaccacccccatttctgacacaaactgcaagttcaggaggtgctcaaaattgcccttaggtttgataagtctagtgaaggactctgagaactcactgaaaactattatactcacaattatggtttattacagggaaagaatttagattaaggtcaaccacagaaagtaaggtgtagggcagagtccaaggaagtaccaaatgttgagcatattacttcactggcatcaatgtgtggcaatgtgcatggagttagtcaacctgggaagctcacccaagcctcagtgttcagagtttttattggaactccattatgtaagcatgattgattgcccatgtggttgatcttagtcttcagtctcccccaaggtctactgatactgtgtaacccaaacgcctaccctgaatcacactgttggtctttcttctatggccagttcctaccctaagtcatattgtcccattgtcacttaaggcccccagacaaacaaagacaatcctatcaggcatgaagattacctctcagaagctgagggcaaagtgcagatctctctttgggtaaggctaatccttcacagaaaagaacttcctccacctgtttataaagggcatatatgaaaaacctgaatctatgaaaacccacagctaacatcttacttagcagggaaagaatggatgcttcccccctaagatcagtaacaagacaacactgtctctcttaccacttctattaataaaagaagttcaagacaaggacacggaaaattacaaaaccccattttagtaaattcaagccttacataaatgaaaagacatgttgttcatggattggaagacttaatacagtctttcttcagtatccatgggggactggttccagaacccctcccccaccaccaccacagactccaaaatccttggatgctcaagtccctcatataaaatcgtatagtatttgcatgtaactgacacacgtcttcctgtatacctttttttttgtttgttttttgagatgagtctcattctgtcacctaggctggagtacattatcacaatctcagctcactgcatcctctgcctcccaggttcaaacgattctcctgcctcagcctcccaagtagctgggactataggcacctaccaccacacctggctaatttttatatttttagtagacacaaggtttcaccacatttgccaggctggtctagtcttgaacctcaagtgctctgcctgccccgccctcccaaagtgctaggattacaggcataagtcatcatacctggcccctcctatatactttaaatcatctttagattatttataatacctaacacagtgtgagtgctatatagttgttctactctattgtttcttatttatatttttgtcgtattggttttatttattttttaatattttcaattgtggttggtgaatcaaaaatccatggatgtgaaacctgtggatatggagggccgactgtattgttaagaggtcaacacttcccaaattgatctactgattcagtgcagtccctatcaaaagcccagctgccttttttgcagaaatggatatgtttgtcccaaaattcatatgaaaatgcaagaaaccaagagtagtcaaatcttgaaatagaaacacagagttggaggacttaacacttcctgatttcaaaatttactacaaagctacagcaatcaagacattgggcatgtatgggcataaggataaacgtatagatcagtgaaatcgaattgagggtccagatataaaccctaatgtttattatggtcagttgatttttttttacaatggtgccaagactattcagtagagaaataaggctttttaaataaaaggtgctaggacaactgggtatccacattcaaaggaatgaagttggaccccaccttacatcatatataaaaattaattcaaaatgaatcagaaacctaaatgtaagagctaaatctcttagaagaaacacaggattaaatccttgtgcttggattgggcaatggtttcttagatatgacaacaaaagcacaagcaacaaaataaacagataacattggactgcattaaaattgaaaacttgtgccttcaaggacactaccaagtaggtgaaaagacaattctcagaatggaagaaatcatttacaaaccatacattttataagggacttattctagaatatataaagaactcttacaatgcaatgttaaaaagacaagtggctgggcatggtgactcacgcctgtaatcctagcactttgggaggccgaggtgggcagatcacctgaggtcagaagttggagaccaacctggctaacatggtaaaaccccatcttgactaaaaatagaaaattagccaagcatggtggcacacgcctgtaatcccagctacttgggaagctgaggcaggagaatcgcttgaacccaggaggcagaggttgcagtgagccaagattgcgccattgctctccaacctgggcaacaagagtgaaactctgtctcaaaaaaaaacaagtaacccaattaaacgagtgaaatatttgaatagatgtttttctaaagaagataaacaaatgggcaataagcacataaagagatgctgagcatcagtagtcattagagaaatgcaagtcaaaaccaagtgaggtgtgatttcacacctactagggtggctagaataaaaaagacataataacaggtattggcaaggatatggagacattggaagcctcatacactgctggtgagaatgttaagatggtctggccacatcagaaaacagttcggtagctaaacatagaattaccatatgacccaaaattccactccttagtatatgcccaagagaagtgacaacgtatgtctacagaaaaacttgtacacaaatgttcatggcagcattattcataataacaaaaagtggaaacagcctaaatattcatcagttgctgaatggaaaagcaaatattgcatatctataaaatggacaattattcagtcataaaagggaattaagtactgatacatgctacattatgaatgaaacttgaaaatgtgccaagtgaacaaagccagtagaaaaagccatgttgtatggtttcatttatataaaatgtccaaaataagcaaatccatgaagacagaaaatagattagtagttgctaaggacttggagaaggaggcctaaagagagattgctatatgaaggttctttttggtgtgatgaaaatgttctagattagattgtggtggtggtgatggtggttgcacaattctgtgaatatactaacaaccattgacttgtataaaggggggattttatggcatgtaaattatatctcaataaagttatgaaaaatcagatttatcagattaaagtagcatagtttcaaacatgtcaactcacattttaaattgaaattaatgaaaatttaaatgttatgtaaaaaacttatagttagctaaaataaaaagatacttctccgaaccatttaatgtttatcatactgttcttagtttctgtttttttaattgacagttttgcaaatttaatgcagtatttctcttttaatttcttaaaaatgtacttagattgtcacagtgaaaatgaggtttaaaaattaagcataaataagaaatgacatgacagaacaagattgtaattaccaaacagctgtgtttgataacagaacagggcagttcgtgccactgcactccagcctgggtgacagagtgagactctgtctcaaaaaaaatttaaaaaccagtttatttttgagatttcgtaagtttcccacaattatataaactgcaaggcctgggagagaggcagagaagtgtagggttagaaaggaaggctggatccagctcacactcataataagaagggctatttctttctttcttttctgactcgctgtttgagaaggtttttcagatagagagtttatcagaaccataaggtaaatgactctttccatactattgtgcagttatttcctgaatcatattgctgtttgattcagtgtctggaaatctaaatagttgggatcattgatggatttgttcagaggccaaaaccctgataagtttattaatgaacatcagggtaatttaatcttcctgaatcttcatggaacatttgaaacccataagggagagccacaatgtaaacgcctacagaaattagagaatgttaattaagtacatcacgtaaagataaatattaacagattatagcccaaactgatttcagaagacctgggttagcatttatggtaaattaattgagactaggaatgatgagaattttaatgaagtgactggtttttcttcagctgctttcaaaattgtgaaaacctggcttggtccagaagcagtgagcttgttgaagtttacaagcaaaaatgaagtccaggactatgtcagtgtagaatacctgcctccccacatgggtggaactgtaagtatttgaaacttgtttataaaacaatactggataatggcacattaggctgtatactttcctcaagggaaaaagaaaagtagtaccataatatgcaaagaaatatcacagatacccccaaaatagcaagtagtgttacacacatttttaaagttttaaagttaattttttattttttaataggtaatatatttatgtggttctaaactgaagagtattcagaagaataatgagaaataagtcttcagtaaaaatatcacctcctacttctgtttccaaccaccatattccctccccagctgaatttcttgtattaatttgcagggatatgtattacccatataaacaagtatagtatataatttttcctccctctcatctcttctaaagtcagtgtatttatgtgctagtgtgcatcctgcttttctcttcacagtacgtcttattccaaatcaatatgtagcaggctctcatactcatttatggctgcatagtattctactatctagacataagttagtgaatttcctcttgatgtgtctttagtgtgcttccaattgtttgctgttcaacagtctttttagttaaaaagatactattaagcatatactatccagatttttttgagctgatttttactacttataaaaaaactgtacaacttatggacttggtacgctttgggttaacttcataatgtttcacttatttgatttttttgcaatctattttttatactgcctgcctggcaaaattgtattcaatcagaattagcaagaggaatagtttcgatatgtccttctgtttattgtctttgattagaaaagacctgaacaaatatttttaatttgaagtctgcttctttcttattctaaggctttatatttcacattttcacctagaaaaaccaaatatacttcatttcaggtgctatgcttgatttaaaatgtgattttatttatttttaataatttgctcataaaattgttatatcttaaataattataattaatataattcataacattttaaataatgttaattttatgtatagaaacggttattttatttcccctctctgtccttagtgatatgtttcttcagaattacagtcaaaattatagtaggactactattttttaacattaatttttaagtattttttttcaaaaaataatacatatacatgattttttaataaagtaaatacaataccagagattgaaaagtataacagtaccatgaaaactacatctgccttcccaggtccatgcccactgccactccctaaaggcagtcaccatcaagttttctatccctctggagttatctattacagttttttacacaatggtcacataccatatatattgtccatttgtacttttttcacatcttttattttgcaggttacaccatattgattcacagaggtctatctcatttttaaaccaaaatattccactgtatggacgggtataacataattgatttaatcactcttcttttaaagggctgcactgatagttgtattctaattttttgccattactagttttgctgcagtgaatatccttgtaataattcttaatatatgtgtgcagcgagaatgcatacagaataaactcctagaaaaaaatctgtgagtatagtttttaatttagatagctgttgccaaatttcctctaaagagattgtgcccatttaccaataatgtgtgagaattcttgaaccacctccttgccagcatcgcatattctcatttttgtagtcattgccagtctcaggtaaaaaatatttcactgtcattttaatttgcatttctttaattataggtgatgttgaaaactttcttatgattcaaaagacaattttcattctttttcagtgtattctgtatccctcttctgtattgttacagaacttatatagttctttaaaaatacacacacacacacacacacacacacacaaacaacatatacatttaaagcttttatccatctgaaattctttttggtgtagagagcgagctaaagatctaaggtgattctgtatagatggctagccaattgtcccacaccacttattgctctttttctttctggtttgaaatgcttcctttattttaaatttcatgatctaattaagtctgttttcttggccaaagtaatgaattgtaaatctactaagagagttatttctctacccaccatttagtaggctcatgtgaaattattttcttgtaggatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaaggtaactttataaataaaatgaaactgaatcacaagatgtggtctatccccaattctgacactagccagctgtgtgattttgggtaattcacttaacctgctacccttccacatttttgtgtgtaaaaagaaagaggaaggatgggattagctgaccagaagcaccactttagtgtatttaagtctgattccaggccagggcctgtgtcttatacctgtaatcctagcactttctgaggctgaggtggaaggatcgcttgagcaccggagtttgagaccatcccgagcaacatagggaggccctgtctctacaaaaaataaaaaattagccagatgtgatggtgcacacctgtcatcccagctactctggaggctgagttgggaagatcgcttgagcccaggaggtcgaggctgtactgagccatgattgtgccactgcactctgacctgggtgacagagtgagactttgtctcaaaataaaataaaggctgattccatgcttttgtataaagactagcaaaacacatctagaagtaattgttttatctaaaatttttttatttgtctaaaagtaattaatttaaaactttgatttagttcctttctctaatttttaaaagagcacttagtagttgtcactttttacaagtaatcaggaacttgatagatggataaatacaatgttataatttagaaaaatttaaagactcttaagggaaggaccatattgtattttctagagtaacctatgttatgtataatagtaggcactaaaatagatgttaatggtcatgttaatatatgctaaatagttatcctttttttttgtctttagattaacccaaccgaatctacttccaaagcagaagaaaatgaaaaagttgattcaaaagtgaaagctttcaagaaaccattgagtgtatttaaaggccccttactacacatcaggtaatcgtcaaagattttattagctataattttataacatatcttgatcaccttgagggagccacaaaattaagaaaacttctatttggtttttgaaactgtagaaatataaaaccaagagttatctgaagacttaccttggtttccagacgtagtgcatatgtttagctaccttgctttcttctattatgttgagtgtctttaaagggttctcatcacacatcagataataaaactaaatatttatatattaataaatctgaatggcatgtattttcctcacattactgatactattagacttgcccaagtttgggaatgccagaaatgacactaaagtaaggatttgttgattttactttccagaagccaaagatgaactggaaaaataggtttgtgactaaagccaaacttcaggacatctctatttttctgctaggttatttgattcaaaagattccaggttgtttctttcagcattgtataaagacctttttctcactgatgatgtttttggttggtaaatatattttgccttacgttacattgctacaccaactttatgatctcatgtagcattttctgtccctttacttgaaacctttctgtatagctatgttttatgtatatctcttatgaacaatatagccagacttttaaaaaatctaatctgacattctctaattgatagtattagcttgtttacatatattttgattactgttatatttggatttatctccgccatctatatgtatgaaagacagcaagcaagagagacatagatgcgcatgcattttctgtttttcatggtttttctttcccattttccccctttggagtttatcttttttgtttgtttacttgttcccatttttctccctacttatttggaagttacacattctgttttcactgtaaacctgttacatcataggtccttgcctgtaattgtagaggtatgacaggaaaagcaggctagggagaaagccagacagcttttcacctgcacattgggctctgctcctcccttcctccgcccccggtgaagtcccagagctgctcctacacagacacaaggacctaaccaacctctgtcttcctggagctgctcacagttgttgtgctggttactaagaacaatgagatccataaccttgtggttttctatgacttacttaagattaggctctagaagaaagccagcaaccatgcaaatttaccaccttatccaaaactaggcaaagcccttctgggagagctcattcttaaaaacatgtgttagttagattaaaaaacactcccaaggtacagacattcctgatataaaattaacctatttaaagatgtatctcaaaatcaacggcttgctgaaaattcactttagttaaattattcacctttttatataaaacaaaaacactattcttcccattgttttgagccacctgatacaatttggctaatgtaactaaactacacaaactgcttgaatcttttaaatttttttttaggtcataggcattacaatggaaagtaatagtaaaatttaaatattgaagctcattgattttactatttgattagttcttcctacagctcccatcccaaacttacttttatgtttacttttctccttccctattacttagaaaagctgctatatagtaagaaattattctgttaaatacattcctaatcatctttctttttaagttatgctcttttctgttggtgtatagaaatatgcctcattctaattatttgtaattaggtaaagttgaagcagcaatatcttctttgctttattatctataaccttccaaatagtttaaataagcgcaccttaagatagtgctgattataggattaatcagagccttcataactctctcttctgttcttcctggtttgcttttgatcttggggaaaaccgtaggactttttaaatagtgtgcattgaatcagtaagattaaaatacaaaattgtattaggtaattgttttgtaagtcttttttggtgaaatgtctttatacaaatgagcataagatattaactaaatatttttcttcaagctaaatgattagattgtcatttattctgattattacaaatgtcttatgtttttgtcactccctagcccagcagaagaactgtactttggaagtacagaatccggagagaagaaaaccttaatagtgttgacaaatgtaactaaaaatatagtggcatttaaggtaaatatcttaaagatacaataaattatgtttgagaatttgacatgggaagtgattttagacatattctaattgaaagattgaaaattttgaacttgtacagtgtttttatttatgacaatttttaggcatgttgtactaccttctggttctaaccaagtcgcatagctttatcaaaaaattttccctgaggtctgtatctgaatcttttacgtgcagtaataggttaatgtctaagttaatacaagggtttaatgtttgttgtaaataacaacccaagaaaaattactctttactatgtgaataatttaatttataataacagtgaaacataaaactataaaattgatagtgcattttccccaagtgtggtatattctggagtgtagtttatatcggatattaacctgatactgagcattaagtgtaacaagactaagtccgtcactaccccgtattgtaggttttcctgccttaaatcttctatttaatttagatgtaactaccaggatgttcctgatgtgctttgattatctactgttttttaatttctgaacaccatggtattaataacatgcaatctaatgtgcattctgtttttgtgaatttatgtcattaaattcaggcaattaacaggataaatatttaacagatggattgttttatttaagagggagtctgaatgacaatttgacttatatatgagtatgtttttagataggtcgagatgcttttttcctgttagtggggaaaaaataccttctatgcataatcgtcaatgttactttgtaaactctttgttcattgattattcactgctaattttttttttagggagatatacctaatgctaaatgacgagttaatgggtgcagcacaccaacatggcacatgtatacatatgtaacaaacctgcacgttgtgcacatgtaccctaaaacttaaagtataataaaaataaaaaaaataaaaataaaaataaaaataaatttttttaaagtcattcttaagccatttccccccaaaaaagcataaaggttgttatgtgactactgtgtttataaataggtgagaacaacagctccagaaaaatacagagtcaagccaagcaatagcagctgtgacccgggtgcatcagtggatatagttgtgtctccccatgggggtgagttgtcacttagtagccacagcaggtgttgggtgtggtgggggtaaggggacctggaccttggctctgagtcagcagagatgtcaggctagaatctagaaattagcagagtatcacgagtcacctcacctcgctgtagacatcttttttcccacatgtgaaatggggtggtcaaagaggtctctaaagccctttccagcattaaaatgtattgtttctaacaagtaaaattgtttaaactgacaccaattgaaattgaatttcaaaagagaaatttcctcacttttagaactttttcctttttaaagacatttccattttcttctttttccttaatgttgagttccagaataatgctttaaaccacatgcatatccaaccgctttgaaggttcctgtttatatgctgaattacccttttggaatgcaggtttaacagtctctgcccaagaccgttttctgataatggctgcagaaatggaacagtcatctggcacaggcccagcagaattaactcagttttggaaagaagttcccagaaacaaagtgatggaacataggtaagcttttccctcacattcttctcaaatgtagtgggaagaatcagaaagagaaaagtgcctc

SEQ ID NO: 1205 - DNA, 35285 bp, mus musculus; identical to SEQ ID NO: 195

SEQ ID NO: 1206 - DNA, 79944 bp, mus musculus
gcggccccgggcgcagccccggcccggcgcgagtaggaggaggagctgcagcggccacggccactccggcaggtccgcggtgctgccagaacccgccgacggcgcgggctgctggtccccgctcggaggaggcgcggggggccccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatggtgagcacccctgttacaccccccgccctccacacccctcggccgccgcgctcctcctggcgccgcgcggtgctcccccttcacttgccaacgtgttccgtttcttttacgtttcccgctgcgacggtgttggttcccaaggtcaactgtctgcattttctggctctctgctaccgttaaaaacaattccacccctattccacgtttctgcattgggaacccaggaaaatgaaagggacagaggtggtccggttccgtctgccccgttcggtctctgttgcaaacctcttacccaccacctcccgctccagttgagctcgatagggtgtgtgtgcctgcgtggtggctggaggtgggtggcttcccaggtgactgcatcacctcaggggacaggccacagtagggagtggggacgaagtctgaaagtgtctttgcttgggtatgggttagtggggcctcttggacgccacatccatggtcagcctgggtgggtacccactcctgaggtccacattcccaggtctcttaatgataaagtcagagcatgaagtgtggtgaaaggtgagcagtggtccaggacccagagtgggtggcaccaccatgtcaggcctggacgaggagacaggcacgcctcctgctcttatgtcccgagtggaaagttatacccagttacttgctttctcaaacgaagaggagcttttgtattcctaagacggtaacagggagtgagtttgagatacatttccgaatgtatgaaggggaaaagtcgtggttttaattccggagtcagccatcttttgttgttaggggtgggctgatgctaccatccttttctagatttaatggtacacagtgtgttacatgcacagtggtcagtacaaatctccctttattacatggatgtcagccataatctgagtcatccctcttcctcttctgtgccccctgcctcccccctcgccctgcccatgactccaaagtggagtcaggtattctctttttgaatgtaattcagtggtgttaaagcccctgaattggcatcctcacacgaaatagacgagccacttcatgattgttcccaacggggaaaattttattttatcacatatactgagggatttctttattcagtttccatccaggtgccctgatagagaatggaaagcagaaaccttaacctttaatgtgaaaattacccttggttctgggccttgcttctcatgtttcttgattagttgttgacagccggggctcatggccaccaggccctcgcagccaaaccgtgtaaggggcaagcgctgttaagagccctccagttttgatgaagtagtgacctacacagatcttgaaacaggaccaggtctaaaaccgagtttggtgattgcgaattataggtctcaacacagactttggcctccatccctgaccgttgttgagctctgtggtttgtgtcagttggtgataaatgactgatgccaggcctgcaggtaagctgggaggtttcctgagaagacagacaggggggaattgaagcacgtggtcattgcaggtgattgactccaagccatgatgcaaatgaaaattgcctttatatagataaccgtgaaaatatttttatttaataggccctagacccagtttcttaaaggacaatgtgaaataggaggtagatttgtcagattcgtaaacacatgctcaagggatggaaaataaatggggatttgaaaatatattttctggagagtactccgtgttctgaggagttcaatcacctttatcttaaggcttaaagacaacagtggaattttcctttgctgatacgtacttttaaaactcacctccatctttcagccatttggttgtgctacagtgtactgttttattttgtgaacaatcaagttacaaatctagtgtaactgatggctgttcagaaaaggcaatatcatctcagcattcctgtgtaattttgttctatatctttgagtattagtgtttctttaaatgtataaagaaatttagtttgtcaatatgtgatgtctcaggttatgccaaatattaatattttaaggactgtctgtaattgtgagaaaacatttcttctttctctcaggtatgtttggtcttctactgcaaggtccccctaatctgaattctaatgtcatgtgattagctaattattcatagtatactgaagactattgggatggggattttaaactgatcttaaaattcagtttgcaaatcttttaaaaaattgtctgcatttaagatgtacaacatgatgttttgataaacacaatgaaatgattactactgtcaagcaaatctttgaacacaagtaaatccagtaaagatttttcaagacttctcttttttaatagtaaaaaataaaatttgatttctctatatcaatagaggaagtgagtaattgtcctcttggctctgaataaggaacgacaaaaagacctaaggaaacatttttaaagtatccactgtgtgctgggaacccaacttaatttctggaggcaaacaatttaacttttaaatgtttatgaatgaaagagttcaactgtgaatttcaaaactctttattttgagaaaaagttttaaaatgtaatttctgccacctttttgtgtttaagtgacactttaatctgagaagaacagcgtttacatttaagataaatttatatatatataaatttatatatttgttggtatagtcgtaaaatatctctggaaggacatgcaatagatgagtaacattggtttccttgggggagaggaactagatggctgtgaaataggagtgggagggagaggtcaccatataaccttgtatgcttcttggtcttgtaatagcttttttttttttttttttccaagacggagtctcactctgtcgcccaggcttgaatgcagtagcgcaatctcggctcactgcaaactccacctcccggattcaagcaattcttcatctcagcctcctgagtagctgggattacaggcgcccgccaccatgcccggctaaattttgtatttttagtagagattgggtttcaccatcttggccaggctggtcttgaactcctgacctccacccacctcagcctcccaaagtgctgggattacaggtgtgagccaccgcacccggctgtaatagcattttaacgtgctcctcaaatcactcaatttgacgcctacttctccctatttaaatcacattatgttatcaattttcttcatgacttttcaattcttaattgtgcccttggagcttttctgagccctgtgtctgggatggagataaaatggggaaaggggaagagatttctctctctctctccctccctccctccctctctcaccctctctttcccactcgctctctccctctttttccttccctttattccattatcctcagagagtagtcaatgttacattagcagtgatgtgcacaaatagaccccataataagtgcttgcttggatgcagaggacctaaggaaaataaaagacacactgtgaatgcttaacgtttaaacagaaaggaactcccccacccaccaaaggacacttataagcattcctccctgacaggccagggcagctacaagggaaggtagctacagacctaactccccaggaaggttgaaagcagcccccagaccccaccactggagctgcaaggcagcggggccaggcacttgcctgccaccagtctaacctgttttgtcaggccagggagctcccagctgtctgtctctgttatgtgattaagtgccatcctaaagttactgggccctacatgtctttgcagcagaaatagaaagtgtttagggcagggaaagttggtataaacagactgtgccagttcattgtggttctctctcagatgtacggtagttccacttcccccataatgtttttgtgacaactgatatggatccaaaataatctgactctgccatgctaacccaccacctgcttctcgcttcctcctcctccaccaccccatcacctttccaaaaatatgttgatcagcccctctaggttctatgggttgtgggctcactgttgctgtggtggagctggattgctaagcacagcctgagagtgggctcataggcagagtctgaaggggaaaaagatgactctttgcggtaacatgaaattaacatttgaacctgtaagcaaacattttggaaccatctccttcctggttaatcaggagtccccccttttaagagcccctcactttggccccagttgggagcagcttctgtatggtctcactttggtaccagataaccctgggttcaaatgctggccctgttgcttataaaactgtatagcattggataaactctctgagccttagcttcctcttttggaaaatggagattatgttacctcacagaattgctgtgttattgagatattctaaagggtcaagtgcagtgtctgacacttaagcacttggtaaatattagttcccattctcattttaggctttgtgattctttggcaggctttactacttgaggtttgttcagtagtggactgttgtaattttaaaatgcattaggacacagttagtggaagtgaggaaaattgtatattttggggtgagcttttggttaatacctagaaaaaaatttacaacacacctacccttttaaaattttatttattattattattattattattatttgagacagagtctcactctgtcgcccaggctggagtgcagtggtgcgatctctgctcactgcaagctccgcctcctgggttcatgccattctcctgcctcagcctccagagtagctgggactacaggcacccgccaccatgcccggctaattcctttttgtatttttagtagagacggggtttcaccatgttagccaggatggtctcagtctcctgaccttgtgatccgcccgcctcagcctcccaaaatgctgggattacaggcatgagccaccgtgcccggcccacacctactcttttattcagcattttcaattcttggactttcagaaatctatcagaaatacttgtgctagcatgttgcaatatatagacagcaatatttgttgcagtggacataagttgcagaactcatcagatgagactggttaaattgtagcacattcccattaaggaatactatgcagcgataaaaagaggtgttttgagatgtccttttaaggctactgtccacacataatgttgtggaaaaaaagcaaggcacagaacatcatgtatagtattattctatttgatctttcaataactatatactgtatatacacaaacatgatgtatgtaatttatatatgatatatgtgcttttatggaaggatatgcaagctttatcctttgggagcaggatgagttgttgggagagagagaggggaggtggtacttttcctttatattattctaaatggcctgaactttctttaatactgacacattacttttgcaatttaaacattatttaaaaatgaagcaaataacttatgtagcaaaaaaatgctttataaacagaagattgtactatgtggttacatagcattttccttggattgtcgaaatgttctttgtaaagcggtctctggatataaagaatacttttacttattatttgaaagttataaatggaagtaaaatgtttgtatcttaaaaaatagaaaaatgacatttactaaaagcatttcttagaatattaaaaagttaacctttgtggaacgctgtaattagaaaaatcacaatttttcaacctctagtgatagtttatttagacaagggttttcaatgaattccagaatcctaggtgaaaggttattggggaacatggtacttgcaaagtactatcaccccacaggttacttgcctgttgcaaagaaaagaaggtacctttacagtgaagaggtctggcagtcaccatcttataagcaagtcatcaaatgtatccttgctcattgtgggactatctagtatcatggtatacaggaagtgtacagctttacctatgtagtatccttcctgtatgtgtttaatctgaatcaaatcaaggacttagacacatcttccagtttccaggaaatgcagaggatagagaaacaagttataaaacaccatgagaaaacaatcagataaatccaatatatgggatgatctgtaagacagttgccccagactcttcaaaaagtcaacgtcaaaggaaacaaaaaggcagggtgagtgttctagattaagggaggtcaaagagactaaatgtagtacgagaaacttgattggctcctagttcatgaaaatgaattataaaagatgttttggggataggtagggatatttgaatgtagactgggtattagatgatattaaagaattactattattttttgtaggtgtgataattgaggttatgcaggagaatgtactcattctttggagatgcaagctgaagtattcaggggtaaagtatatgaatcctaacatatgcaactttcaaaaagttcagtaaaaaaatatacataccacctatatagagaaaacaaatattgcagcctactagctaactgttaaatgtaggtgcctagtgaaagggtatgctttatatactcttctttcaacttttctgtatgttttgacattgtcattaagatgaaagattggaaaagaagttaatccccctcttagcttgcaacctattaacttccctgcctggaagattgtacaggtgaggctgtacacatcctgtctgttactctcattaaactctttctagcactgattaacactgtttgacattagtttacctgaggtgaagttaggcttacgtgacttgagaatcagtaacttctttcttctttttttttgagacagggtctcactgtgtcatgcaggctggagtacagtggtgtaatcctagctcactgtagcctggacttcctgggctcaagtgatcctcccacctcagcctcctgagtagctgggactacaggtgctcaccactacgcctggctaattttttggtattttttgtagagacagggtttcgccatgttgcccaggctgatttcgaactcctgcgctcaagccatccacctgcctcggcttcctaaaatgctgagattacaggcatgagctgctgcacctggccagtaacttctttttcattttactttttgtttgattcttaagttcatgtattttttaaattgcctctgtttaacatacaagagaatatgtgttaggagaattttctcttttagttaaagcatgctacctggcttttaatcaatatgggtatttatattagagtaatactagatgttaaaacaaaccaaccccaaatttcagtgacttaacataggagaaatttgtttttcacgcatgtaatggaccagtgcaagggactggcaggtggctgtctctacgttgtgattcagggaccagatgccttccatcttgtggcttccccatcccatatggccttggaatcctcctcctccagttgatgaatgaagcaaggaaatgaagatcatatggggaagacttatgtgctaagcctggaaatgttctgcatcactttgcccacttctgttggacagaacttggttacaaggccacatctaactggaagggagccagggaaacatagtctagttggaagaagaggaacaggtttggaaagcagctagccaatctctattgcagtatttgatgagtactttgttatacataatccagaaaagagaagtaataggatttgcatgtgatttgtgtgtaccacagtttacatacaaatgtaaaggacactgaaggacatcttggttgcttccaagtttgggcaattatgaataagaatatttaagttttcacccttcaaaaacattcactatgttgtttctaataaaataatagtagaaaaaaatagtaactgtttattgagcacctgttagaatagtctgtcaccgtgttaagtactttgcatacgttaagccatttaaccttcacatcaaatgtatgaagatcaggctgggtgtggtggctcatgcctgtaattctagcactttgggaggccgaagcgggaggattgcttgagcccaggagttgaagaccagcctgggcaacgtggcaaaaccctgtctctattaaaaatataaaaattagctgggcatggtggcatgtccctgtagtctcagctacttgggaggctgaggctgatggaggattgcttgagcctgggaggtcaaggctgcagtgagctgtcattgcagcaatgcactccagtttgggcaacagagtgagaccctgtctccaaaaaataaaaatgtttgaagatcctaatattggtcccattttcccaggtaaagaaattgaaacctaggtcaagtacctcctttgtttaaggtcacatgtttgaaattgggaaattgggatctattaaaggatgaactcaatatagctgaggatgtatttggccaggatagagcagaacctgaatcccgcccattaccacttcctaggaggtctctgagggaaatctatgcccagagtagaaaacaaagcaaagttgaccctttttttttcttttttctttttgagacagagtcttgctctgtcccccaggctggagtgtagtggcacggtctctgctcattgcaacctccgcctcctgggttcaagcgattctcctacctcagcctcccgactagctgggattacaggcatgctccaccacgcctggctaatttttgtacttttagtagagacggggtttcacgatgttggccaggctggtctcaaactcctgacctcaagtgatctgcccacctcggcctcccaaagtgctgggattacaggtgtgactactgtgcctgacccaaagttgactcttttatgttagctaggacttttgctctcaagctccagtgtagaacagtgaggaatgaggcaggatgacaaggaaaacttagttttcctgtgctagatcagcctgggggccttggatccaagtaggagcaaaatgcctgctcctttcagcccaaaggtcacactccaggtgttattccattgatatgacagaaggctaccagtgttttaggggaaaaaatgttaagagctgttcagagtggcagcaccaggccttcgtacatgagagtagttgcttgaaagcattctcatctctagacctcactatcagagaggtggggaggcggatagggttgggtctgtgcagctctcatgtctctccactctatgctagttgtgatgggcatatcagaatcttctggagagcttttccaaaatgcattagaatgtaagccctgggcagacagagatatctatcttttgtttgtgctgtctccccagaccctagaacagtgcctgacacctagtagatgctccagaagtgtttgtttagtgcattctattttgtctatcaaaaaataagatgctataacgctacctagcattaaaggtccttccttcaagttcttccctcccctcctccttcaagttcttatgcctcagcttcacactgacagtgaagtttctgagaaggaaacctttgtgtgtgaaaacatttgcctgaattgcagcagactgtttaaggaaggaggatgaaggaataaatgagtacacaaataatgtgtgtttgcagaaaagtatgtgtttggctgataagtcacgtggtagttgtttattttttttttggtaaaatatacataacataaaacttgccgttttatccatttttaactgtataatttaataacatttataatattcacaaagttttatggccatctccactatttccaaagattttttattgccccaaacagaaactcttccagttaagtagtaactccccatccacccttccttctagcccctaatagtctctaatctaccttctgactttatgaatttgcctattctagatcattcatataagtgaattcatataatatttgtcttttgtgtctggcttatttcatttggcataatgttttcaaggttcatccatgttgtatagcccatatatgaacttcattcctttctgtggctgaataatactgcagtgtgtgtgtgtgtgtgtgtgtgtgtgtacacgcacacacacacacacactccacatttatctgttcatcagttggtggacactcgggttatttccaccttttgaataatgctactatgaacactcacatagaggtatgtgttagagtccctgttttgttttccttccttctgtctgtccttccttccttccttccttccttccttccttccttccttccttccttcctttctttcttttttttttttttgacagagtttcactcttgttgcccaggccggagtgcaatggcgcaatctcggctcactgcaacttctgcctcccaggttcaagcagttctcctgcctcatcctcccaagtagctgggattacaggcatgtgccaccacgcccagctaattttgtatttttagtagagatggggtttcatcatgttagtcaggctggtctcgaactcctgacttcaggtgattcacccacctcggcctcccaaagtgctgggattacaggcatgagccactgtacctggccatttgttttcattccttttggctgtatacctaggagtggaattgctaggtcatatggtaattctatgtttgactttttgaggaaccaccaaactgttttccacagtagctgtaccattttgtattcccaccacaatgcacaaagattctaatttgtccacatcctcttcaacacttgttgttttccatttaaaaaaaaatgatagccaccctagtaggtgtgaagtggtatcttgttgtggctttgacttgtattcccctaatgacttatttgtatttcccttcatgtactttttggctatctgtatattttatttggagaaatgtctattcaaattctttgccatttttaatcagggtttttttgtcattgagttataggaattctttatatattctgaatattaatctctgcctccttccattatattgtcattgtcaaagagcagatatttatatattgtgtgctcattaacataggtttataattttttttgcatttgcttttttaatcatgtaggaaaaatgaggagtttgaaacccaaattgttatgtttacctgtttttttaaaaacaatattattttgtttataaacgaattatttcatgttgctttattttaaaacaatttaaaaattgatgcataatagatgtacatagttttgaggtatgttataatttaataaatttgtataatttgtgaagattaaatcagtatatttgagatgcccatcaccttaaatatttgtcttttctatatgctagaaacatttgcattattcccttctagctatttcaaaatgcacagagattattgtaaactgtggtcaccctactgatctaccaaacactaggctttgtttcttccaccaaactgtatatgtgtactcattaatcactttctcttcgtccctcctccctacccttcctggcctctggtaacaactagtctactctttatcttcataaaatccacttttctggcccccacatatgagtgagagcatgtgatatttatctttctgtgcctggcttatttcacttaacataatgacctccagttccatccatcctactgtgagcaagaggatttcattcttttttatggctgaataatattccattgtgtatatataccacattttctttattcattcgtccattaatgggcacttaggttgattccatattttggttattgtgaacaatgctgcaacaaacacaggagtgcacatgtttctttattatattgatttcctttgttttgggtatatacccagtaagtggaattgctagatcatgtggttgttctagttttagttcttgaggaacctccaaactgttctccatagtgattgtattaatatacattcccaccaactgtgtatgagggttcccctttctccacatccatgttgtcatctgttgttgcctgtcttcttgataaaagccgttttaactggggtgagatgatataaaattgtagttcttatttgcattcctctgatgattagtgatgttgagcattttttcatatgctggttggccatttatatgtcttcttttgagaaatgtttatttaaatcttttgctcatttttaataggattttttttttgctgttaagttgtttgagctccttatatattctggttattaatctcttgttggatggatagtttgcaattattttttcccattctgtgcactgttttttgtttgtttgtttgtttgttttgagatggtgtctcgctctgtcgcccagcctggagtgcagtggcaccatctctgcttactgcaacctctgcctcccgggttcaagcgattctcctgcctcagcctcccgagtagctgggattacaggtgcccaccaccacgcccaactaattttttttttgtattttcagtagaaatagggttttgcatgttgaccaggctggtctcaaactcctgacctcaagagatctgcccaccttggcctcccaaagtgctgggattacaggcgtgagccactgcgcccgacctgttttttttttcttgattgtttcctttgctgtagtacatttttcatttaagttactgtactttttggcttcagaattctaatgcttcttttttataatttctgtctctttactgatattcttattttgttcatacattgttttcctggcttcctttatttatttgtctgtggtttcctttagtttttttttttttttaatagagacagggtctctgtcacccaggctggagtgcagtggtgtaattgcagctcactataaccttgaactcctgggctcaagtgatccttctgcctcagtttcccaagtagataggactacaggcacataccaccatgtttggctaattaaaaattttttttttatagagacaagtgcttactatgttgcctaggctggtcttggactcctggccttaagcaatcctcctgcctcagcctaccaaagtgttgggattacaggcgtgagccactgcctttcattcattaagcatatttaagacagctgatttaaagttttcatctcatatatccagtgtctcagcctcctcagggatagtttctatcaatttttttcctttgaatggcccatacttttcctcccaggtagctgcagggtgtttttgttagtttgtttgtttggcctaccttacaacatttttcaagcaatgcttgctgcttgtccgctatgagtgggctccaagttaggcaaaatggagatgagaacctcaagtcattcctttgggtagtcttcagacaggttagaacaaacacaaaaaattgcaaacaagccctgctctgctccatctggaaccagggaccaggggatattggctgctgtgttcaagaccactgctgagctggtgagggggtgggacaagggcaagcaaaatgccacacagccttcctgccattttaaagttgccttgttcttgagtcattgttcacttggttgctgtaaacctttgactctcttctagaattctgacaaaattggctctgacagcttctgcttgtttttcaatgtttctgtggaggaatgggagtttggagctgtctactctgctattttgctacacagccttcctaccattttaaagttgtcttgttcttgagtcattgttcacttggttgctgtaaacctttgactcttttctagaattctgacaaaattggctctgacagcttctggttgttcttcaatgtttctgtggagggatgggactttggagctgtctactctgctattttgctaatgctctttaccaaacacggtatttttaaaaaattaagattctgtatatcttcagagacactgcaacctttggggaagaacagtgttaagcgctatgttttgttaaacttaacatgttactgagatagtaaatgtcccagaggtagtctttcaaattgtatcataggctcttatcacatattttcactgagaagctagagatcgagaaacatctaactagtgtgtaacttcaggttcatagtcaacaaattttctccttttacttcttcatatctacccctaaaactaattttaggtaaagacacatttacttcaaattgtcttgggttattaaaaggattgattctcagattacttttgttgagtgtagaatgaacgaggtgtagcagactccagttacctcccaatatccattgttcctttcattgttccagtagaaccctgttctaattagctcagcatattgctgtgcaataagaaaactacatttcctggcctgtcttgcagctgggtgtagttatgtgatcaagttctggccaaaggtaggaggagaagtatgtgggatttatgcaaagtattcttaaaggaaaggggcgtgcccctcttctaccatgccttctgtctgcttcctggaatgtggatgtaatggctagagctccagcagctgtatttggtcaagaggtaaccgtgggaatggagaacacttctggcaatacaataaaatagatgacgctgtagtctctgatagcatagagctgccatgccagatttggactgaatacttatgtatttcttataagtaagagagaaatgggtttttgttatttgctgctgaacctgaatgtaacttttacatcaggcactgagttgcacttggaacttgggtgtgacatacagggctgttttgaggacttggtgcagatgttcgtacctatgatgaatgtggcactgcttgggattctaggggaggccaaagagtagacagtacagggccagagaaaggatttgaggaaaagattcagatttaaagtgttgcttatatttgggaactttggggcatctaacaactacccatgcatttgatgatgtgccagaaagactcacaggatccagagacagttgtattaaagccatgacttattacagtgaaaacatacacagcaagatcagcaggagaaaaagacataatgggtggagcctgaaagagtaaatgtgagcttcctaagttctcccttaggaggttgggggtggggctgcatagaacaaactttttccacctgcaattaaatgtagcggcacatatgcagtgtttctgtttagggaagcttgcttaagacacaggcttttctgtattgagggctgatcaggcgttcttattgaaatttctgagtttcagaaggaaagcaggtgttcaccataaatcacatttgcaaaagcaatttagcctggctggtacagcagaattcagtgttccaggcacacaaaacaaccttatcaattagtagcataggtaatatctcacaggccaagttcccaggacctattggaatatgaggtcatgcaggcatgccctcctagagatagcaacatcaggcctgttatattaactttttcctgcagagtaatatgtggtgtcaactggctgttagctttttgtgttcttgaggcttcctcagtttcatccacactcttatttttttcatcattacctttttaggctcattaattttttttttttgagatggggtctcactgtgtcacccaggctggagtgcagtagcatgatcacagctcactgcagcctcacactcctggattcaagtgatctcctgcctcagcctcctgagtagttgggattacaggtgcatgccaccacgcccggctaatttttaagaactttttgtagagataggatctcactgtgttgctcaggctggtcttgaatgcctgggctcaagtgatcctcccaccttggcctcccaatgtgttgggattataggcatgagccacaacacctggtcagatttattaatttaatttttaacattatcacaagtaaaattgactttttacttttgatatacagttttatgaattttaacatatagatagatagatatgtgtaaccaccaccacaaccaagatgaagacttgttccagtgtaaaaaactctcttgtactaccacatcacttggacaaccactgatctagtctccatcactgtaattttgtcttttcaaatatgtcatataaatggaattgtacagtatgtaacattttgggactagccttttcactcttcataatgccttggagattcacccttgttgttgcatgtatctataattaggtctttttttttttctctgtgggattccattttatgaatgtatcacagtttatttgccagttgaagaacactaggcttgtttcgagtttttgataattatgaatagggctgctataaacattactgtacaggtttttgtatgaatgtaagtttttatttttctatggtaaatacccaggaatgggattgctgggtcagagggtaggcatatgtttaactttataagaaacctgccgaactgttttctagggcaactgtacattccatctagcaacatgtaagagtttagtgctccacattctctttagaactcggtattgttagcatttttaattttagctattctaatagatgaatagcagtatctcattgtggttttaatttatatttccctaatgttgaatatattttcatgtgcttatttgtcatttatatatcctttttggtgaaatgactgagtcttttgcccatttttaaattgtactgttgtttttctttggagtttcgagtgttctttatatactttgatggaagtacttcattagatgtgtaatttgcaaatattctctcctagctttggggttttttttttcttttcagtatcttaaccatatcttttggagagcaaaacttttaaatttcgatgcagtccaatttatcaacttttatttatcatgcttttggtgtcatgtccaaaactatataatcccaggttgagaagattttctcctatgttttctcctaaatgttttatggttttgcattttatatttagatctatgatttattttgagttaatgtttgtagaaggtatgaggtttaggttgagtttttttatgtatagatgttcaattgttccaatatttttgatgttcttttgttccaaaagattgttgttgacaatcttttcttcactgaattactgtcacaacattgtcaaaaatcaattgtccatatttgtgtggatctatttccggactttctattttattccactgatctgtgtatctagctctttgccaataccacaccatctttcttactgcagttttatagaaggtcttaaaattgggtagtgtgaatcctccaaccttactctttctcaaaattgttttagctgttctagttcctttgcctttccatatacattttagagtcaggttgtctctacctgcggaatgtcttgctggtactttgattggaattgtattgaatctgttagtcaatttgaggagaatggacattattactgtattggattttctgatccatgatcattatatttctctgcttaggacttctttatctcaaaaatgttttatagtttcaatgtacaggtcttacatatatttaatggacttatccttaagtatttcacatttgtgatggtattacatttgatattattttcataatttcaatttccagttgttcattgctaatatatagaaatacaattaatttttatgtatgagtcttgtatcctgtaacctcactaaactcacttgttcgttttagtagctttttttttttttgcttatttcatacatagacaatcatgtcatctgtgaataaggacagttttatttccttctttgcaatctggatgactttgattccctttttcttgcctaattgcattggttagaacctctagtacagtgttgaattagaagtggtagggccatagtggacatccctatcctgttactgatttttggggaaagcaaagtttttcaccattaaagctagctgtaggttttatttgtttgtggctattgtaagtggggttgccttcttgatttctttttctgctagttcattataatgtatacatatacatatacaatgtatatattacaatatatggtcgatatatagaaatgctactgctttttaatgctgattttgtatcctgcaaataaattgaatttgtttatatctaagagttttttggtggaatctttaggtttttctaaatataagattatgtcatttgccaagagggataatttgactttttttccaatttggatgccttttatttatttctcttttctgattgctctggtcaggaatttcagtacaatgttgaataggaatggcgaaagtgggcatccttgtcttgttccagttcttagaggaaaggctttcagcttttccccattcagtatgatgttagttgtgggtttgtcatatatggcctttagggaagctttaattttataaacgtgttttgatctttcttgttattgtaatccccatatacatacactctgtcctttggtatttatttttcttgaactgtggacttcgtgtgtgtgtctgtatgtttatacagttaagtatatgtaaatgtgtttaaatacacatttaaaacaagtctaccatggactatctttttctagtctaggactctgttgactgctgtacatttttgctgctgagagaactagggggaaagaaaagattgcattcattaatagagtgggctatgaatgagccagaatgattctccccagtggtatgaataagacaattgtctattttcaatggcagtgttatgctgagtgtttatgatggctctgaagagagacagacaagatggtgatactgtagtgatttttatccattgtgggaaaatctggtaaagagtcaaggtctgttatagcagatgaagtcctcccagcaaagttggggaaaaagagacaggtagttcagtaggagacaactgtttaccaaggcattggaagagctgagaagccaaacagagtgtgttgaagcaagctaaagatgagcaacagcagaaagctactttcatccctggggctgacacagggagaaggtagtattaccagagcccaggaatgaggttgcctggcaagaacaactattgtgagggctgttgggacctggtcggagggctgtctgatgggagcttcagccatggagaacacatagccaccaccagagagagagagagagagagatgataggagtcactccttaccctgtgacatgtgcagagcaagaaagggcataaaatggatccaagggccaagactagcatgaagattcttcttcagattgaatacctattctggtgtgtagtatatccaatacctacatacaatatggaagggaggaaaaaaactgtgtggtcagggtcaagaagaactaatatgtctgtcaccaaactcagggggaaaggaaatcaggtatcgaggcacaagctggaactgctgtggtaatatatgcctgaaggatgggatgaggtaattatgacaaatttctcatttaaaatattaagcatatgtgttaaaaaacctcacatcagctattttgtaagcttatctgtcgttgttttattgaattattatatattatttagggagaggaagtggcggtagatatggagatagaaggaagaacactttttatagtgtaagtaatgttgtaatttaatatacacattaatctttgtaggcacaatggtaggtatttctgtaacaatgccttttttcagagagccacattaacagtgataccctggtatctccaggaccgtttttgatgagtttagccagagaaactgtgcccggggtgggtactaatctctctgaatcaatgctatttggtgtttgtttgtttgttttgttttttttttttgagatggagtcttgctctgtcgcccaggctggagtggagtggcatgatctcagctcattgcaacctttgcctcctgggctcaagcgattcttctttctcaacctcccgagtagctgggactacaggcacgtgccaccacacctggctaatttttgtatttttagtagagatgaggttttgccacgttggccaggctggtctcgaactcctgacttcaggtgatccacccaccttggcctcccaaagtactgggattacaggcatgagccaccatgccaggcaatgctatttggttttatagtaatgtttcttcaatttctataattcaggcagttcttgaaaaattcctaaatagagttgggtttccgtaaaagaggacatttccacaggagtcctgtaattaagcccttgctggtgtggagggcttggtctggccagtgacacaaggtcaagggatgatgtaaatttgagaagttttttctgcctcaaaaggccaaatggacatcaagcatttatgtgttacaagaacatataagttaacgaaaacaagttctgtctttgaattatagcaactcaggtgagactattagttatttcaaattgatcacaattcttgattgaatgttaatactatagatgtccaaacttttcttttcttttctctttctttctttctttctttctttctttctttctttctttctttctttctttctttctttctttctttctttcttttttttgagacagggtctcactctgtttcctaggctagagtgcagtggtgtgatctctgctcactgcagcctccacctcctgggctcaagtgatcctcccacctcagcctcccaagtagctgggactataggtgcatgccaccacacttgctagtttttttttaattttgtagagatgaggtctcactatattgcccaggctggtctcgaatttctgggctcaagtgattctcccacctcagtctcccaaagtgctggaattacgggcatgagccactgcacccagccccaaactttctgtgtatgactgattagcaaaatattcagtgagttattacctaatgcattgtaatttgcttgatgcaatctttcagtatttcaaatatccagtccttgtgggaaaaggctgataaaactggaaatactaataaacagacttctggtttcagcctagatatgtggcatgcagagctgtcatcattacaaaaagaaaaagctggacaaatggaaaattaataacttttcctgaacctaggaaagaaatggagatttcagggcaaatgattaacccaaaatcaggagagagacaggtaccactgaagaaagaaacaggacctgaacatttgcttacttgggacagatactgttgaatggcatataaaccagtaagaagattaaaccagaaatttgtaatgaattgctcaaagttgggggccacagatatagggatttcttgccctcttacaggcttttcctccaggattcctgccaaatactcacagggaagatcagggagaatcctgagaaagtttttcctgtgtcttggctggggtagaagaacaaaagccactgccaaaatctgcctagatatctctccatctccctaaggaacaaaagtcttaatctgcaggaagaaagtaacagaaagtgagactactggtggaaacccactgtaattggggaaggagaagaggaaaaagaaagaagatctactttcttgggaaaggaaatgaatgcctggtaggcctggcattgtgtttggaggaggatcaggaatgcttatgaaggccacaaccccaagacccaggttcacagtatctgcataatattgcaaattaatcagaatatcagaatacccccatttctcacctccttactataaagctaacaagcatcaaataaaaataacaatggaataaggcctggggagctgcaagagagagattgtctctggggagcagtacaaaaacttaaaagtcaagtatggagacccaaagccaagcgaggggaagacattgagaaaaatcttgtggcaaattacccaatgccataaaaacaagctatcagtacaggaatatgaaggctcctgaggccctgagcataaccatggaaacaataatcttcaaacctagcccacctcctgattacattaatacaaacctcaatgctaaaggcctatcagaaaaaaaggtgtactcatcttcaagtataaaaaatatttacctcagtaccattttgatacaaaatatctgaccatcagaaatacattacaagaccaaaaaggcaagaaaaggcaagagacaaagcagtcaccagaaccaggctcatgtatgacacagatgttggaactatcagagaatttttttttaaactatgattaatatttttgaagctctaatggaaaaagtagataacatgcaagatcagataagtaattttaggacagagatggaaaataaaagaaaaaatcaaattcaaatgctagaaacaaaaaatacagtaacaaatgaagtggactgtggactgtaagagtcaatgaacttaaagatattggaaggcaaagggtgaaatgatcagaacagaatatccaagagaagagtaacaatgtcaaatggtctaacattcacataattggaatcttgggaggaagagagagaatgagaatgggacagaaatattagaagaagtaatagctgagagttttccaaaattagtgacagatgccaaaccacagatccaagaactttagagaacaccaagcaagataaataccaaaacaataaacagatacccaggcatatcacatttgaactgcttaaaactaaagacaaggtgtctgggtgcggggagagggcagggggaggagtagaggaggaagtgctatatacagaggaaaaggataagaaatacagcagacttttcagtaaaagaccatacaagcaagaagacagtggggtggcttgtttcaagtgttgacagaagaaattgtcaacccagaattctatatccagtgaaaatgtccttcacaaatgaagaagaaaaaagactttttgagacaaacaaaaactgagggaatttattgccagcagacccactctacaagaaacgttaaaggaaattcttcaggcagaaaaaagtgatataatttggaaaactggatctacaaaaagaatcaaagaatgtcagaaatgaagtaagtgaagatgaaatcttttaaacatttagttgttctaaaaataagtgatttttaaaaaataaaatttataacaatgtgttgtgtgtttatagcatatgtaaaagtgaaatgtatgacaacaatggcacaaagatggaagggaggaattggtaaaatactgttataaggtcctatgctccttgtgaagtggctatattatttgaactcagattatttaaaaacattgtaaaccctaggataactatttaaaaagtttaaaaagaggtataaataataagtcaatagaggtgataaattgaataataaaaaatgctcaataaaacccagagaaagcagaaaaaagaggaaaaaaggaacaaattgatcaaatagaaaacaactaacaagatagtaaattttgaccctccatataaatagttgctttaaatgtgaaaatgtgaatcatctaaaagacagagatcatcagattggattaaaaaaagcagacacaatttataagctgtctacaagaaaaagcccactttaaatataaagacatagatacattatgctaaatgaaagaagtcatgcacagaagatcagccactgtgcggtttcatttatatgaaatgtttagaaagggcaaatatatagaaacaaagtaggttaatggttgccgagggctggaggtggaaaactggtatttactgttcatggataccagggatcttattggagtgattgtgttgatggttgcataacttgttaaatttactaaaaatcattgaatcgtatgcttaaattgagtgaattttgtgggatgtgaattataactcaataaaattgatttaaaaaaacaataagtgtggtgatgcaaaaaaaaaaatgactgtggccagtttggccatttcttgtagaagagtctcagccacctgaaggcttccagatccttaataactcatcaggtccctgccagcacagggaacatcatagacctgtcagcacttaaaggaacaaaagtaatgaacatttacattaaaaaatgagtgtgaaataatgacattcccagaaaaacaaagattgaaatgttaatgtctgttcatttttgcttcagtgatttggtattctgtttttagatgtgtccactttaataatttttatatcttcctgatgacattatgatgaagggtctttccgtctataatatttattgtctagagtttatttcatctgatataaatgtagttactgtagtgcttttatgattggtgttacctggcatatgttttccagtccttttactttaaacgtatgtgtgtgagtgtgtgtgtgtgtgtgtgttttaatctacaacaatggttctcaactgggcaatttagcccccttgtgacatgtgacagtagctggaaatatttttggttgtcatacctgcatggcagctactgacatctaatgaataaaggccagggctactactaaatatcctatgatgcacagaagagctcttacaacaaagaattatccagcctgaaatttcagtggtgctaaggttgagaagccctgatctaaaatgtgcctcttttagatagcataaagtggaatcttggttttttccccagtgtgacaattgctgccttttgattgcagtgtttagtccagtcccctttaatgtaagtattcgtatggttggatttatatctgcaattttgctattattttctatatatttcatgaaagttttgattctttgtttttttttcactgccctccatgtgtgtgggagagatagtactagtttaccattttaattcctttgtgttttttccactatatttttgagttagtttcatagtggttgctctagggattacaatagtcatcttaacttaatctactttagtgtgatgctaatttaattccagtaaaatattgaaactttctttgattctaactccattaccacatccctccatcatgctagtatcataaaatatgtatcatctatataagctacaaccctaacaatacagcattgtaattattgtttaattcagttttatgtctttttaagagtttagagaagagaaaaaggtatacatgtatatagtgttttatagttactcatatttttacattttccagtgctcttaatttctttgtgtggctttgagtcattgtctagtatcatttccttttacctaaaagacttcctttagtatttcttgtaaggcagatctgctagcaacaaattctttgctatggatagcagcaaatagtcttttttaggtttgtaacgtgtatatagcccttaataatgtattgtttagtcttgcctatttttgtgcttcctgagtcttttttgccaatattttaaaaatgttgagtagttaatacatttacatggtctacatataaaagcaaatttaaaagggacagattgaaaaggtatacctcacccccaactctccatttctccttaacattgtagtaaccacttttcttagttgtttgtcatttcagtgtttctttacataaataaaagcaaatacaaatatacgtgctaatttccaccttttctctgaccaaaggtagtataccatgtgtcctgtactgcaccttgtgtttttcatttaatttgtcctagagattttgccatattggtacgaagaggtattcctcattcttttctttcatagctgcgtggtattctattgtttggatgtaccataatttagtcctttgttggtgggccctagggttgtttcttatagtaatcgaacaatactgtagcaggaaaccttgagcatcttatgtatgtgcgggtgtatttgtagaatagattcctgggagtgggactgttagattaaaaggtatatgcatttgcaattttagatgacattgccagattcttctcattagaagttgtagcattttttacttcctccacaatatatgaaagtgcttatttccccatcttctcaccaacagggtgtgttatcaaacttttggattttttttttttttcttgagacagtctcaatctgtcgcccagactggagtgcagtggtacgatcttggctcactgcaacctccgcctcccgggttcaagcgattctcttgcctcaggctcctgagtagctgggattataggtgcccaccaccatgcccagctcatttttgtatttttagtagagataggggttttaccatgttggccaggctgttctcgaactcctgacctcaggtgatcctcccgcctcagcctaccaaagtgctgggattacaggcatgagccaccatgcccagccaaacttttggatttttgtaagtatgagtgaatgatgtctcaacgtcattttattttatttttttgagacaggctggagtgcaatggcacaatctcagtttactgcaacctctgccttctgggttcaagtgattcttatgcttcagcctccctcttgagtagctcggattacaggcgcctgccaccatgcctggctaattttttttttctttcagtagaaacggtttctccatgttggccaggctggtctcaaactcctgacctcaagtgatccacccgcctcagcctcccaaagtgctgggattacaggcatgcgccaccacacccagccctcagtgtcattttaatttgcatttctcttataagtaatgatgaatatcttcttaaaagttttaagggccattcgtatttttttttctgtgaattgcctacttatattctttgtctattttttttcccatgggcttgtcttttctcttgagtcctaggagttttttgtatattacagagattagccctttatctgtgataaattgcaaatattttttctgtttttcctttttagctttgcttatgtatttcctccttcttagaagtttgttgttataactatcaagtgtttagaatcttcaatttttttatttttaaatttttattaaatttttattttttagagacatggtctctgtcatccaggctggactgcagtggcataatcatagctcactgtaatctcaaactcctgggcccaagcagtcctcctgccccagcctcacaaatagctagaactacaggtgcacaccaccacacctggctaattttaattttaattttttttaattttttatatggagtatggctatgttgcctaggctgccctcgaattcctggcctcaagtgatcctcccaccttggcctcccaaagtgctgggattacaggcataagccactatacctggcccatttttttttttaagatgcctggaccttatcattagaaagatattccccaccaaatggctaccaaattgtcccaacaccagtgactaaaatgtccatattgaccccactgatttgagatgccttctctttcatccactacctgtatatatttctggactttctgttctggtccattggtatttctctattcatgaattaataccacagtaccaattgttatggaccttagaacatattttaaaatctggtagggctagtggcttctcattgctttttttccccctgagtcttcctggttcttcttgtttgtttagttttgtgtatgactctaaaattagctttcctgttttctgtccaaatgcctattggtatttttattggatagcattggatttatgagtcgaagtgggagaatcatttttatgatgttgattcttcctattcaaagatatcctgtgactttccattggttaaagccttttgtgttcttctggagtgtttttgagtcttccacttaagttttgtacatttcctaagtttattcctggatattttatatttttggtactattataaacaaggtcttctcatccattttatatatatatatatatatatatatatatatatatatataattttttttttttgagacagtctcgctctgttgcccaggctggagtgcagtggtgtgatctaggctcactgcagccttgacctcctgggctcaagcagtcctcccacctcagcctcctgagtagctgggactacaggcatgcaccactctgtccagctaattttgttcattttttgagaagaccaggtctcactttgattcccagggtggtcttgaacttttgagctctggtgatcctcctgccttggcctcccaaagtgctgggattacaggcatgagccaccacacccagcctcatccattatgtctttaacctctattgttgttctagatttcctttattttctttttttaaaaagattttgcttagctccatttttttttcatttttaactctcattttcaggatattttctgaaaattttcaagtgattcttactatatttctgtcttacagtgaattatcttgaaaattaatgtaagaaatcaacattgtgaagattgattaggatttctagtgtaaatgttggatgtaatggtgagtttatcataagtccttaaagggtatgaaggctgaaccccagagtgtattttgacattggtttagtgaaggcaggctgagcatgaaccagaacttgaaaccgtgaaagttaacagattagctactgaataactattttagctaaatgttgagtggcaagggttaaaaaataaatatttatccaaaccaaaatatcaccaacttagaatgaacctctgagttaaataaatctgaaattttattcagaaatatattattattgcaattttattaaaaatttcaggaatcatctttttaaagtttgacattgaaggcaagagatcatttcttttctttctttcttttctttttctttttttgatggagtctcgctctgtctcccaggctggagtgcagtagcgtgatcttggctcactgcaacctctgcctccctggttcaagcgattctcttgcctcaacctcccgagtagctgggattgcaggcacccaccaccatgcccagctaattttgtatttttagtagagatggagtttcgctgtgttggtcaggctggtcttgaactcttgacctcaggtgatccacccatctcggcctcccaaagtgctgcgattacaggcatgagccaccacgcccagccagcaagagataatttctcagcaccatcagttgctagattgcatgtgagttcattagattgtatgtatgtcatacgaaagacataactagaaattaaatgcaactctaaaagtttgttttgcaatgttatgttaatgcaccaaacaattctacaaagactagaattatgttataatctaatatctattattgtatcttgtattgttacttaaatttttaggtatttattggcttaaccaaatatattgtttttccttaagttatttaattattgcactcttcattcattaattcactcaaatattcactggctgtttacctattttttaaagtattccctttttaaaagccaggtttattgaggtataatttacatacaacaaaattcatttcttttaaatatacagttcaatgagttttgacactgcgtacacttgtgtaaccaccaccaaaatcaagataatagaacatttctatccccctggaaatctgcttttgcagaacatgcccttcttctaccctagctcttggcaactactgatctgttttctgtctctatagttttgccgtttttagaacatcatgtattagataaccttttgttttctagcttctttcacttagcataatgcttttgagattcatctgtgatgtaatgtgtatcaatagtttgttcctttcttattgctgagtaatattcaattgtctggatatatcacagtttacttatatattcaccattcattgaacatttgggttgttttcagttatgaggtattataaataaagctgctatgaacatttgcttacatgtctttgtgtgagcatgggttttcatttctgttggaataaatacccaaggtgagattccttggctgcatggtgagtgtatgtttaactttaaaaacctggcaatcatttttagaagatctgaacatttttcatttccatcagcaatgtagaagcttttcagttgttccacacctttaccaacttttgttatttaggaattttaaattttatcaattctagtatgaagtggtatcttactgttttaatttgcatttccctactgactaataatgttgaacatcttttcttatgcctatttgccatccatatatcctctttgaagtctctgtttgtacttgtttgcccattttaaatttatctttttttgtctaattgagttgtgtattttatattttctggataccaatccttcgtcagataagtagtatgcaatattttctacctgtctgtggcctgtcttttcatttcctgaactgtgtcttttgaagaacagaaattttaagtttttgacaaagtcctgtttatcaattaatttttcctttatggcttgtgctttttgtgtttatcttaatacattcttaataggttaactattttgtatatcaaattaaccgctctcacagtcattaattggtactttattcttacaataataaagatcaatatatctctcaagagattaatacaatttttattccatcttacatatagacttaataaatacaaatggtacactttttttatattactcagattgttatgctggtcactgtgctatcgtgcaataattggtcactaacagttaagggataccaaaaatgatattgcaggagacgttcagttacttctgaagatcagagatgatttttgcctaagtcaaactttgggatatccctaatttacattggctagttctttgtgtttattttggcattaagtacagatttaaatctttccacgaagagactcaagcgcaatcataatttttcacaagactaagtcatatgctggttacccaagcatttgctgactatttgttgtacagggacacaggctctactcacaaggatggctatgggaacattgtgcaaagggagttattaagcaattagctttgcgatccctctggcgtatcttcctcctgctgtggaatcaagagagtggtttggatgaggcttgtggcctttaatatttcatgtgtataaggatcactgtcatccagacatcggaacttttaaaattccatgactttccttcactgtaccagagtaattgtgacccagcttcatttgcttaaatgcagttaaggttttgctgaatttttagtgtttaagagattgcattggggtaccaggtgataggaagagaaaataaaaggtttctgcccccgagttgacactcttgagtgtaacacaactgtgcacagtgagccaaagggtgaagcaggctgtgtggctgagtttagggtatgcggggatcagttgtaggagatgagacaggaaacatattcaggcaatagattgtgggggaccttgattgcccttttggggcccaaggctgcattccattaaaaagtgaattggcattcatgagtgaaggcttgggctgatataggcctacctgagagtgaccctggcctcctatgctctatgttgttgaaaacagtaagagttaagataattgggggatgttgcgcctgccttggttgtcacatggagctgcccctccactgggaagctgtaaattggcatggggacatttggcatgcctgagggtggtataaaagattgacaggaaaaggggctgtttttttcatcagcaaaatccgcaaacatcttgcctatcatccgtggcagtcatacgtgacctgtgtggatgagggacacaagtagctgtagacttgggtagctgctggtcctcccattgagatgaagctgcggtccctgatgggtttcctctcctgtgtcctaatataaagataagtaaatattgtattaaatggaaaccagtgtgtgtcttggggctctggttgccgcttggtctcatcaccatagctgtgccactgcactgacaccttgaaatggaaggttagcattacaaactgggctaactggactcgtgttggggatgcaggggatctgaatgggggttagagcaatgacaaggtgagaatagggaggatcatctgccttcaggacagacactgagactcctgtcagcagttctggcacatggtctggggaagaaggaagaacagaacttccaactttagctctggtgagaggtctgaatggggccaagggctcttcttagctgtttaaacattttaaaagtttttattttaaataacaaaatttaacagtgcttatatatgccaggcaccattccaggcattttattttatttatttttattattttgtttttgagacagggtcttgctctgttacccaggctgcagtgcactggtgtgatcatggctcacagcagccccaatgtcctgggctcaaacgatcctcccaacttcggcctcccaaagtgttaggattgcaggagtgagccatggctcctggtccattccagacattttataaatattaactcatttaattcttctaacaactcaataccatttatagtttcctgatgagaaaattgaggcacaaagaagttgagtgacttgcccaggtcatgtagcttagtaaatgatgaagctgagctttgaatccgggcagtctgcctctagactccctgctctgaacccttctgattcctatagctcctcttccccatttttcctcataagaaataagtggtttatggttttgctccagtgtttgggtttctttgcggccgctcaagatcaaccaattcttcgggaaagtgaaacccaaggctccactgcccagcctgactgactgcattgacatggtggacagcagggcagaatccattgacaagaagatttctcgattggatgctgagctagtgaagtataaggatcagatcaagaagatgagagagggtcctgcaaagagtatggttaagcagaaagcctcgtgagttttaaagcaaaagtggatgtatgagcagcagcagggcaatcttgcccaatagtcattcaacatagaacaagccaattataccatccagtcattgaaggacaccaagaccacggttgatgctatgaaactgggagtaaaggaaatgaagaaggcacacaagcaagtgaaaatcgaccagattgaggatttacgagaccagctagaggatatgatggaagatgcaaatgaaatccaagaagcactgagtcgcagttatggcacaccagaactggatgaagatgacctagaagcaaagttggatgcactgggtgatgagcttctggctgatgaagacagttcttatttgtatgagacagcatctgcacctgcaattccggaaggtgttcccactgatacgaaaaacaaggatggagttctggtggatgaatttggattgccacagatccctacttcatagattggcatcattcaagtatatcttgtaaaacaaacacatattatgggactaggggactaggaaatatttatctttccaaattaacgtaacagatttacgtttctttcctttctttgaaggaaagtttaattacattgctcttgtattttttccattaggagactcattgtttgggaaacgctttttttgtactaaaatttgattccttttttcttatgaaaattgaacttagtttaaaggtatctttggcttgtatgacttgttttcattcattagtaataatttgaaataaaactaaggaaatggaatgttaaaaatctatgacactataactctgcagtctcaaaatgacctgataaactgataagacaaagatgagattattggggctgttcatattatgtttcagaaccattttctattgtggtattataggttggttaaagtgatggcctttttgatgggttttgttgtgtcttgtgaacaaatcattactgtgtccaatattggaatggagttatcactactgtatcatgagtgggtatttttattctatggttccctcagtattacatcttgacttgtaatcaataatgaatatttcttgatatttaatgtataggacatttatttatactcaataaatatttttcaaaaggatataattttaatgatatcacttcagcttaaaacctctactgcggaaaccacatttaatagaattttaatgtcattttagcctataactccactccagaaaccaagttaaccattgtgaggaaagagcaaggaacaatctgggcttgggccctgggtctaccatttactaactactgagtagtctattcaacttctctaagcttctgtttccttattagtaaaatcatgcttatatctcatagagcttttgtgaggaataattgaggtaatggtcataagtaccttattaaccgcaatgggctattctcatatgagggattgttaacaataaaaaagcaactgcttcaaaaaaaaaaagtggaattaattgtttttaaaatgtcatcgttgctgctgttgttgttttgagagggaatctcactctgttgcccaggctggagtgcagtggtgtgatctcttctcactacaacctctgcctcctaggttcaagcaattctcctgcctcagcctctcaagtaactggggctacaggcgtgcgccatcacgcccagctatttttttttttgtacttttagtagagatgaggtttcaccatgttggccaggctggccttgaactcctgacctgaagtgatccacctgcctcagcctcccaaattgctgggattacaggcgtcagccactgtgcccagccaaaatgtcattgttatgactgagtcagaacactcacacaggttacagctgcacagggtgacatcaatgggcagtttccaggaagcatggattccttatggtgtgtgtgggtgaatatagcacctgccctttggcttgtacccctgtcctacataccgaggaagtcctatgctatggttttagggcctcatatcacatttcttgacccgctttgctactgagacagccccctctccaaaattcttgaggtcggaaggtgtatttccccctcctcttggcatccttgacagggtccatggctttgatgctcctgtagtctcctactttgcctttccataggagagtgagtaaattttctttgggaggaaacccgggcaagtctgaacaatgagtgtgcatttggggctgactcagggattcagacattgctttgtggtggtgtttttgctttcttttcttttctttctgttttttttctttctttctttctttttttttttttttttttgtagaaatcttattgccgatacaccacgggctgccccacccagacacattagtcatggcaaagggagcaaatcattcctttttgaagatgagccttatattacatgaatcattatattaatccttacatgaagtccacctgttatatatgtggtggtgattgtattttgtccatatttcctttgctgggtggggagatcaactgtagctttttcatcctgattttcattccttgctacaaagcagtgatttggtttctaggtcggcattgtaaggagcctaatgctttgtcacagtactccagctcctcacactgatggctgaacagaggctgctaaaataggttgatcaagttgtgtttttcattgtcatattttgcaccaaatgaagtgtgacacatcccactctgtgacagaaactgtgagtgacaattggttccgtgtggtggcctaaaattacagaacgttacctgctgcttactaaggaagaatcttctggaggttttccctgtacctctgattggagcccacaatagaacttgtgtatggcatctaataaattgcaatcccagtgtgacaaagacctgtaggcacagagaagaaataacttggtcacataaagttttggagttcccaaatcactcatttaatgttatttttaaacatccatctctcatttggttactttctttaatagtccaattctttatgtgtaatacagaaatcaaatataaatgggattgataaaagtccttctttgcctcgtggaattttagtttttacaaataaccttagaataattcaggtaactaaggtatttggagtaacagtgcttacttgtacatgaagaactcaactatcactctctgttccccatttttctgcaagtaactcaattagctagattaacaaacattgtcacagaaacaaagtgttttttttaaagctatggatccttgtgtttatatttttaaaaagccataaacaggcatttctaccttattaagaggacttaaacaggtgtttaaacactaagacagtgatgattttaaaacataataaaactctaagttaaggcttttgttttgaaacccacattcatagctacttatatgtggaacacctttgtatttgggggcaacgtgctattaaggctgttgttgaccctagtactcactactcgcccttacacacacacacacccccacacccacacacacacccaccagagagaaacagtgtttttttagaacccaggaccatcaaaatagttttttgacttatcaagccttgaactggaataggaaacccacatttgttctagtgtttatgtgtttaatagttcataccatgaagttatatgttgattgcagatgtgggaagcaaaatggaaaaaaatgcatcttgctgacaaacatcgccgactgccttcactaactgcacttagcacaatacgtaatcatcttttctctttgtttactcatttatgggctacccctccctacctgctctagactgaagttgagaaaggcaaggcctttgcttgtcttcctcgagattgctcagatattgtttgcaagagagtccccatagcctttggtgggttggtggctgtgatagggagggtcttttgtcaaccctgggccttcactttggaagctgtgctgtgttgcaattaattctaataaacccatgcagcatctgaagataaccccacagggaattgaattttgaagcaaacgtgtttatttcttggaagcttaatggatggattggaaaaaaaaaaagaatcatttgcttctagctttggaagccagagaaaccacaggctgaggagcatgcccttgtccctcagtctcctattagcttgcagctctaatttctatccagggtaatatgaccgaggggaactatttgcatctttgaaaattccactcttctgctggcttataacaatagaacagtgcaaatgtatcttgtgtgttctctaccattatggataattactaatgaagtctctttctggcaattctcattaagtgatttaattttagaagtggaaagaaccatacctattggaacacttgaatctcaacagactattaaactttattaagaataagaattattccctggaattttgtaagatcaccttaaatcaaattatattttcaaaaaggaccataaagataattgcagtaagaaaaaatgttttaaatcattattaatgtagttatatgtataaggaccagaggcgatccttttgtgggcatgccgatttgaagtcctttgttcagcctgtttgttcttaagtttagattttgttgtactgtgaggccttacgtttaacatccactcatgtgatgctttatcacttttttgagaggttttattctggaaattcaggatatagtcttggcagtctaaaaacgtaggtggttttgctttgttatatcatctcagtgatcttcaggagttatttggatgatcagttccatcagctagggtccccttcttttctcttctctgccacggctgtgagggaggtcttggaggacaataatgccaggtagaggaggatgcaaggtgtatgtggggaattctgaggagttgaatatgagtgtttatgtgtaggggcagatggcagtgggaagtgaaattggcaggtgccagtgctttgtgggccttgaatgccatgttaaggagcttggatttttttttttcccatggatgatgaagctgctgaataattttaagcagggtcatggcgtgactagcctcatttgtgattcagagaaattagtctggtggctgatggagaaggaatgattggggaatcaggggagaagcaggggggatagttaagaaacgactgcagaaaatccagtcagggagcttgaaccagagtaatgataataaggagaagagggggtgatcaggaaaatacttgagaagtagagttggcaggagtgggaaaggacaggatatgggtgtgatgaggtgctactcagtggcactaagtttttatgcttgaatcaaataattgctcaagtcctagaaccaaagttagtttctgaggaaagtcttgtttgtgattatagaacttctcttcagcagacaagaatatgcaggtcaagatctttgatttctttttcataacaagtatcattacaaccaacatacctggaagatgtagcctatagatcttttatgttaccagctattgaggtcctcagtaatgaccttaatcatgtttgttgttcatcttgttcttgtcagaaggctggctgaaaattttggtatttgagagaggaatgttcttaaggaatatattacttactagtttctcaaaaaacaatttaagtcaaaacatcaggaaatgacagattagaccatgttattgtgcccttcagcctttcactcctggaattgcccttatagaaccaaactaactttatgtctttagttttctcttagagctactcatatatggaatgccttcacatttaggagaaaaatgttattaaggctattgaccttcgtggccccctccccctaatttccacaaaaccctgagatagtttcttcttagagcacaagaccaacaaaatatttttttgagttatcaaaccttaagctagagtaggaaacctatgtttgttctagtgttttctattttgttcttgtcagcaagaagcacaaagttttaagcttattttctatggttttcctcaaacaacttttaaaattattatttttgttgtgctcttttatttattttatttattatgctcatatattaactggttttgtgtttttagtttaacccattttagtcagttggataaattttttttattatactttaagttctagggtacatgtgtacaatgtgcaggtttgttacatatgtatacatgtgccatgttggtgtgccgcacccattaactcgtcatttacgttaggtgtatctcctaatgctatcccttccccctccccccaccccacgacaggccccggtgtgtgatgttccccaccctgtgtccaagtgttctcattgttcaattcccacctatcagtgagaatatgcagtgtttggttttctgtccttgtgatagtttgctcagaatgatggtttctagcttcatccatgtccctacaaaggataggaactcatcctttttatggctgcatagtgttccatggtgtatatgtgccacattttcttaatccagtctatcattgatggacatttgggttggctccaagtctgctattgtgaatagtgccacaataaacatatgtgtgcatgtgtctttatagcagcatgatttataatcctttgggtatatacccagtaatgggatggctgggtcaaatggtatatctagttctagatccttgaggaatcaccacactgtcttccacaatggttgaactagtttacagtcccaccaacagtgtaaaagtgttcctgtttctccacatcctctccagcacctgatgtttcctgactttttaatgatcgccattctaactggtgtgacatggtatctcattgtggttttgatttgcatttctctgatggccagtgatgatgagcattttttcatgtgtctgttggctgcataaatgtcttcttttgagaagtgtctgttcatatccttcacccacttattgatggggttgtttgattttttcttgtaaatttgttaagttctttgtagattctggatattagccctttgtcagataggtagattgtaaaaatcttctcccattctgtaggttgcctgttcactctgatggtggtttcttttgctgtgcagaagctctttagtttaattagatcccatttgtcaattttggcttttgttgccattgcttttggtgttttagacatgaagtccttgcccaggcctgtgtcctgaatggtattgcctaggttttcttctagggttttaatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgttttcgtcaggtttgtcaaagatcagatggttgtgtatgtgtggtattatttctgagggctctgttctgttccattggtctttatctctgttttggtaccagtaccctgctgttttggttactgtagctttgtagtatagtttgaagtcaggtagcgtgatgcctccagctttgttcttttggcttaggattgtcttggcaatgtgggctcgtttttggtttcatatgaactttaaagtagttttttccaattctgtgaagaaagtcattggtagcttgattgggggtggcattgaatctatgaattaccttgggcagtatggccattttcatgatattgattcttcctatccatgagcatggaatgttcttccatttgtttgtgtcctcttttatttcattgagcagtggtttgtagttctcctttaagaggtctttcacagcccttgaaagttgcagttggataaatatttaaagtatgtttctgaaatgaataaagattggggccaggcatggtggctcacacctgtaatcctagcactttgggaggctgagatgggtggatcacttgaggttaggagttcgagaccagccttgccaacatgatgaagccccatctctactaaaaatacaaaaattagccaggtacagtggcgcacatgtgtaattccagcttctcaggaggctgaggcaggagaatcgcttgaaccccagaggtggaggttgcagtgagctgagattgtgccactgcactccagcctgggccacagagcagactgtgtctcaaaaaaaagattttggatgaccctacatcagtattttttgggacatttaagaagatgactgctccttgtgcagtaattttctcttaaaaacttcaaaacactttattacacaaatacaagaaaaattaacacaagtatcagggtgatttttgtggtacaatgtggcatttctaatcacctgacctttggtataattagtatgtataatgtatctgtccatcttatagaactcagagcaccttttgagtattttccaggaatatgtaacacaatttcaactttggtttttatgacatagttcttgtctgcaatgctgattacttactcaagaatgggacacccccttcccaattatttcacaatttctttaggaaaatgcggttattctggtggatgcgtgttgccataactcatgagaccaggtgtccacaatggagaagtagggctaggattttttgtttcatttctgtcctgggcagcctttatcgttttggtcagagttctggctttatccagaagccaagtgacttcagtacaaggtggtttccccttccccaaacagcagggaactagaatcagaaacaggaaaaaataaataaataaaaagaaacacattatgatcaaaatagcttcaaataaggttttaaagccacttgggtactatttgcctattgatatcagaatcgtcccttcttgtttgggtataaatcagttagatctccaatttgctaatggttacaatggatattttaaaccagaagagtcagtacatttatgatagccatagagtctgcatgattctatatttaaagtgttttagggggtgagtgagtgggaatttgagaacagacttgggcaaggaaattccttcccctctgtgcttttgtagcacctgtgtctgttgcagcatttgtgctgtgtgctagagcttctggtcttactgaagaggatcctgcctaagtcgtctcagggttcatagcatccagtggctgaatgtttattgaattaaggcaggcaatagggattcctttcttggtttatcaatgtttgtttcttctctttttaataaagaaactggctggtttctatttgcgtgctcaaaataagcatatctttaccaagtcagagccctctaaggccctgcaaattctcaccttaccacttatccccttaatgatatatcatgcatctaggtttatgcatctgagcattggactgggatctagaagtctcaggtctgagtcactccttcagtcttcagtacccatcttcacttgagcagaccacttaatatctctagacttcaacatcttgatttataaaataagattactattataagtcaggggctgtctatatgtgcactgcctgccttaaggacttttgccagaaataaaattaagtaatgtacagatgttccttgacttatgatggagttatgtcctgataaagccatcataagtttaaaatattgcaatttgaaaatgcatttaatgcaccttacctaccaaacatcatagcttagcccagctgaccgaaaatgtgctcagaacacttacattagcctgcaattgggcaatatcatctaacacaatgcctgtttcataataaagtgttgaatagctcataatttattgaataccatactgaaagtgaaaacagaatggttgtatggatactcaaagttcagtttctactgaatgtgtatcgcttttgcaccatcttaaaggggaaaaattgtaagtcaattctaagtcagagggcatgtataaggcttctcaagactgaaaaatacactctgtgcgacatttgtcattttcaactaaccgagaatgagggcacattcgcaaaaatttgattagattcagaatttaaccttataccactggactcatatttttgggatcagtgaatcataatgtagttattaacaattttgtgaccatttccaggaactaactgtaactgagccattacaaagaaaaagctgttcagttatagggacccaaaaatataccaaatcagtcaagtgtttattgaatgcctactgtatgcctgttactgtgctattccacatgtgaaatagaaaagaaatcttacctataggtctgatcctcaaggaatttacagtctagttagggagggaataatttaagaactggactaatctgtgatataaataaatactttaaaaattctttaaaaattatttttaggatacttattgagagaaatgagatatcaatgtgagtaaggagcttgggtagggtcttaaagagttgaaattaaacctgggaacataatccaagtggaaaggaattttgtcaagatggaataatttaatctagcgcaatgtctgatatatagtacatgctcaataagtattaatttgcttgatgaatgaatctctttcaacaaatttatcttctagtttgccagttctctctttactgtgtctagtctgctgttgaacttgaaaatgaaataaaaatgctaaggtcatgtttttcttttccaggatttctattggttctttctaaactcacaatcctctactccacactacactccttaaccctttccctgccttatttttagccatagcacctaccgtattctaacataccatgtaatctacttattttgtttcttatgtttcttcccttattagaaatataacgaagtccagaaaagcaggaatttgtatttgtttcgttcactgacatatatctccaaacactagaacagtgcctgggacatagtaggatctcaaaaaatatttgtcggggatctcaaaaaatatttgtcggggatctcaaaaaatatatgtgttgtccataagtatggaggcaatagtgaaacctgccaaattagattggggtggagatgaggtccttgtagagtccagtaggaaataaaatttggggaggggcttcattatggccagattatatagagcatcctgtgttgaggggaggtttggggcttcaacgtagtaggcatgtatattatttacaaagctgagccaaatatccataatttacttgtcatctgggagacatcaggaaatagcagaaagaactctggctttggaattggaagtatgcaagttggaatcctacttctacagtttaccagctatgtggtcttagggcagttacttactcttgaagatccagtttttttttttaactgtaaagtggtgttaataatccctacctcataaagttgtggtgaaaattaagagataatattgtaagtaaaacccctaatacaaagtgggtgcccagtaagtagttcttagactacactgactgatttgaaactattagcatactaaaatgtactttttctgtttggggcacattacttagagtagtaggaagaagcagaaaacattgagtatagtatattgaggtagagtattgtaactgtggtttaggaaaaataactaccaactgtgagtaaaaatgaaaaggaagatactatatttgggtgttttacagtcacgaaaaaaaaaaacccacagaaataactagtatcttttcacttctccaaaacgttttgaaaccttgagttaattaagaagggagaggaaaatcccctaataatactagagtcactaatagtgtggtctctgaaagtaccgaaccacagggaagtcaccgggttctggaggagatcagctttcctggagtggtccagtcctcatggatattctcttctgggtaggacctgcatgttgacatgaacctagggcactaacttgaccctccgcagaaaaaactttcaatgttaagtcctctgcttgctaaaggtcacccaagaatatttctcctggagaagccttgtgcattttcttttcttttcttttgtcttttttttttaattttttttgagatggagttgtactcttgttgcccaggctggagtgcaatggtgtgatctcagcccactgcaacctccacctcccgggttcaagcgattcttctggctcagcctcccaagtagctgggattacaggcgcccgccaccatgcccagctagttttttgtatttttagtagagacagggtttcaccatgttggccaggctggtcttgaactcctgagctcagatgatccacccgcctcaggctcccaaagtgctgggattacaggcatgagccaccatgcccagcctgccttgtgcattttctatataactggttgttaaagatgttatccttttttgctaattgacccatggataaggggccatctgacagctttgagaatttaggattaagcaaacatttatttctcttaactggttattccctcttatcagattatgagaattaaatagcacacaatgcttcctttttgtttcagttatcaagaaactcagagcaccatgtaatgcttgattacaataacaaaaagtctaggaggaccataaatttacttcctccttgtatgctatagttcagtactgtcgttttctattttaagtggcttgctgtgtagagcatcttaaaggctttacaaaatagcctgagtatacctaatttggcatttgactaatttaacatttccccagatgtgactcaaacattttgtaaatgtagtgaatttaaaagacccaggtgtctagcagtagggacatggtttaataaactgtggcatattaatacactgcatttagaatttttatcttaaattctaaagcaaatctgtcactgagcccttatacaagactcagtgcacaatgtataactgaacagcagtgaacatgaatgaatttatgtttcaacgtgagtaactgatatggtttggatattatttgtcccctccaaatctcatgttgaaatgtgacctctcatgttggaggtgggcctggttggaggtgttttgattaatgggggtggatccctcataaatggcttggtgccatccctgccactaatgagtgagttcttgatctgttagttcaggtgggatctggttgtttaaagaacctggcatctccccactctctcacttgctccctctcttcatgtgacatgctggctccccttcgccttccaccatggttataagcagcctgaggcccgcctcagagacagatgtggacactgtgcttcctgtacagcctgcagaaccatgagccaaataaacctcttttctttataaattacccagtctcaggtatttgtttatagaaatgcaaatagactaacacagtaacctgcaaaaaacataatatggagttaaaaaagggagatgcagcaaaattcattcagttaatacaacagaaaatgctgcttgtcccccagtatctgctttccatttttttcctcataatagacttttagaaggttcaatgacctcccagaaagaagactttattttcttgcctctcttgcagccaaatatgatcatatgaccaagtacttggccaataggatatcagtggaagtgtgtgtgtgtgtgtgtgtgtgtgtgtgtgtgtgtgtgtaatttagaggctgtgccgttaaagggagtgccttccctggttgttttctcgtttccctttgcctgacacgtgggcctgatggtgagggcaacaccctcttggtggtagagcaggaagattagggaggggtagtgagggaggagtagggagccaccacttcatcccaggaatacttatgcactgactcttctgtgaaggaaagagaaacttgtctaagccaccattattttggtctttgttccagcagctacacctgcttcctaattctatatgatactatttatgtaagttaaaatgagcaaaagaatatttattatgtatctgcggacatgtatatttagtaaacctggactggatacagactaaaatgaatgacagttgcctccgaggtagaagggaaggaatgggaccagggaaggaggaaatacagcctacttcctctctttacactaagccacaagggattctctcttttctgtgtgtcgtgctcagtcaactatgtcagagtaggacagtcaattcaatgatgaagaatctgtatgtttgtgatctttgtgattgctttatgccacgcggttttctgttggcttttaacagtgacttttaccccatatgaagtgattggattaagagaaaatagtggctcacccttaaaacaaatgtggaggacagagccatggctgtcataacaggagtgagctatgaaatagacctgggaaaacagatgctattgcagtttgatggtaaggcctgtggcacaggtgttgctggcaggctgcaagaggccccaacagggggccttctccatttgcccagactctagacaatgccattgctggctcaaaagctgaaatcgtcagcagcctgggtgactgtctcttggggtcaggctcacgttaatcaggctcagagagcctgaggctaaaccagagtgccaatcgattaatttatgataagagatttggctgttgcagagcagaatgtatgttcaggctgagcagagcattttttttctgagtaggcaagtagcaggggaccccaggttgtcatcagaaagttgcttagaaaggacagaggaagaacagaggcaattggttatggtatgctcataaatagactggaaaagcctgatgggtccatctccttgctggaatagccttgactccacctctccccactaacagccactgtatcctttcctttatcagtggttacatgcatgatctcatcatctgacttttggagtcagcctttcttctctctctctctctcttttttttcccacagtatttttttcaaactagattccacagaatggactgggttttccctaaacgaatctcaggtgcattccaggtgagtcacattgcagtttggggattcccaggctcttaagggcatacaaacagctcatctggtttactccctcaatttgccagttacatccaacatatgacaattttgctggctaacactgagggaaccttcattctcttacctctaaatctatgggggccctcactgtccacttccctattccaggtacattccatgatgcatttagttgtatttctgaatgcggttcttcttgtcacatggcagtccttctgtcttcccacttgtccctgctttcactctgtttacctaaatgtggaagtgcctaaggggcagtccttgctcacataactttggctctctgatgtgtggctttagagatcatttgtgcacagctagcttccaggtctttatattcagtcctgaatgtattcttacaatacagtcctaaaagtcactccttttataagtagttgttggacaagataatacatatgatagtacaaaattcaaaagttagaaggcaaactgaaaaaccggcctccctttctccctggagataaatgtattccattgtcttctctggagacaaatacactcatcagttgagccatttctgcctgaatgtgccatgctgtatttaaaatcagcgtatgtaataacgcagttggcactgttgctctagagtgccatcaacacccacctagatgttgaggtgccctcccttctcacattgcctaatggttccccggagaaccttgagaaccccactgctatagtataaactaaaagaatggctgctggaatttccttacgatgcttttttgcttttgtagaattcaccttcagttagctatgaactctcagaggatagcaattgttgtatgctgtttctggcatatcccctttagtgctttacacagtcttatacatacagtagggtttttttttgttgttgttgttattttaggtaacattttttgaactttttttgttagtttaggtaatgggtgtaggcatttgtttttaaaaacatcaaaaaaagtaactgctggcagaaaatgtaatgaaaagaagatgagcagctgcctgttgtattatgtattatgatagcttagtacctttaaatttttttttctgaacttatttttatttttgagaacagagtctcactctgtcacccatgctggagtgcagtggtgtgatctcagctcactgcagccttgacctcctgggttcaagcaatcctcccacttcagcctcctgagtagctgggaccacaggtgcgcaccaccgcagcaggctaatttttgtatttttttttacagagacagagttccactttgttgcccacgccggtctcgaactcctgggctcaagtgatcctcctgccttagcctcctaagtagctgggatgacaggcatgtgtcaccacgagtttagtgcctttttcagtggaacttctttccttgttctctgatagtgtaccactgtcctacctcagcacatcccacgacactgcctgagctcctttcctccttaccacttacaacatactatttaacgcatttatcttatttttaaacatctttccccctgctagaatgtaagccctatgaagggagggcaggatttttgtccctgttgttgactcttatgttcccagagcctagcatatggtaagctgctcaacaaatatttgttgaatgtataacctggtgagataccaattgtttatgttgtcattgaattgattaccatcaccaatcctagatttctctttgttctgtcccccactgatactaggtatcagtgctttgagaccaggaagacatttttcgtttctctgcaaacaaaacctgtagtttggggctgagtgacttagaggcatgtggaaggaagaaagaacataatcagtggtgctagaacacaacgccttgcttgggctctgctgtcagtgcctgacatattctccaaacaacactccccacttgtattttactagcctagtttgagtacctctttttttttttttgagacggagtctcactctgtcgcccaggctggagtgcagtggtgcgatctcgtctcactacaacctctgcctcctgggttcaagcaattctcctgcatcagcctcctgagtagctgggattacaggcacccgccaccatgcctggccaatgtttttgtatttttagtacagctagggtttcgccatgttggccaggctggtctccaactcccgacctcaggtgatctgcccacctcggccttccagagtgctgggattacaggtgtgagtcaccatgcctggccttgagtacctttaataaaggtgattcatgtccctatttgttatttccaccacagagtatatcatttttcgtggcttaatttttcttttttaaaaaaatttttgagacagggtcttgttatgttacccaggctggtctcgagctcttgtgctcaagcagtcctctcacctcagcctcccaagtagctggcactaaaggtacatgtcggccgggcgcagtggctcacgcctgtaatcccagcactttgggaggctgagggcgggtggatcgcttgaggtcaggagtttgagaccagcctggccaacatggtgaaaccccttctctactaaaaatacaaggattagctgggcatggtggcgtgcacctgtagtcccagctacttgggaggctgagacaggagaattacttgaactcgagaggtggaggtcgcggtgagctgagatcgtgccactgcactccagcctggacgacagaaagagactcttgtctcaaacaaacaaataaataaaggcacatgtcaccacacctggctcaatctctcctctttttatggttaatatctcttttgattcttttgcttagatgctgtcactctgatattaaggagaaggccagtttattgcatttgagtttgagctttaactaggttatttagtctcacacagaaaaattctgttttgtggccacattttgcccatgtagtcaggcagctgccatgaatatgtgaaccttgggctccctttcctgagagggcagccaagtagaccttggcataaatacagaattgagaggatgctggctagtgacgcgggctttttggtaggggctgcctggccaccttgcctcaagtgatctcctactgtcactgtggatgtcacatgcctcctggctgtgccacttactagtcagatccttaattagttctaaaatggatttcatgtcctttgtgagaacggaattcaccaagatgatatcagggaaatctcattaccttataaacacaaagagatcagatcaacagatcttactttgctgaagagttgggcttttgtcctctagctggcgaggagccattggaagcctttaagccagcagaggtgtttcttttagaatgactatccttgcagtggttttcaggtaaagtactgaggagtgtgagatggatgcagggaaggcaagaagctgtcaaagaaaaagtttacctgaggctgggtgcggtggttcacggctgtaatcccagcactttggtaggctgaggcaggcagaacacctgaggccaggagttcgagaccagcctggacaacatggcgaaaccccacctctattaaaaatataaaaattagccaggtgtggtcgtgtgtgcctgtaatcccagctactcgggaggctgaggcaggagaattgcttgaacctgggaggcggaggtggtggtgagctgagatcatggagaataaaagaaagaaagaacaaataaaaagttcacctgagaagaatggctgcccctgggcagaacctagatgcctccagtgcaggtgaatgacataaggataactcccaggtatctggttctcacagggacagggaatgcagagaagaaacaacactgatggggaggagagagacttactcttggatctgttgagttagaggtgtcagagagatggcaagcagaggtttagatgtaggttgtggaacaccatgggagaactctgtgctcaacctacagttgctagaactgctcctttaaagttcctgctgggtgagtgacttttaaaatataacctcttattatggaaggtttcaaacacagtagagacaatagtataataaaccaaatcccatgtacccattaccatgctttgttaattaccagctcatgatccgtcttattacatctataccttccagctacctcttcccatgtcaaggtgattttgacacaaattctagatgtcgtgtcattttattaggttggtgcaaaagtaattgcggcttttgccattactttcaatggcaaaagccgcaactacttttgcaccaacctgatatttgtaaatatttcaatatttatctctgaaagacagtcttgtaaaaatatagctacaataccttatccatccttaaaaaccatagtaattttgtgatatttgtcaaatatccagtgagttcgcatttccccagttgattttttttaagcttcatttatgatgtaactaagggccctccaacagcatttggttgatatgtctctgtgtctcataaatctctcttaatctgtagatttgggtgtaaaacttttcagagcattttgggatctatttgtgtgaacctgaactataaccagcacttcaacaaaagaaagaggtagaggaatatgggataatgtagggatcttctctttttttccttttgagacagggtctcactctgtcatccaggctgtagtgcagtgacccaatcatgattcactgcagcctcaaactcctgggctcaagtgatcctcctacctcggtctcccgagtagatggaactataggtgcatgccactgcactcagttgattttttaatttttttgtagagacaacatctcactgtgttgcccaggctaggctcaaactcctgagctcaagcaatcctcctgcctaattttttaaattttttgtatagatgtagggtctccctatgttgcccagctggtctcaaactcctggactcaagtgatcctcccacctcagccttccaaagtgctggaattacaggcgtgagccaccacacccagccaagatcttcttaattggaggtgtgattttaagttttttcccctgggaggtatgatgcttccaggaaagcttgataaagctcttgtacttgtagcctctctctcctgcagtcaattctctgtactgctatggtatcttctaaaagtcagtcctgattgtacccctttttagtccagaagtctatgtggcctctgtttcctgtgtgataaagtcttatctcatgagcttggcttaaagggatggctggccatcttccttgtgccaacctccctgcttgacatttggtctccacccttcccctttctcccctgtgtgggctagctccagccatgccactgtatctaatgtgcactttcctacctcatgctaagggctttctctgaaatatacttcacgcctcctctttcctctgtacaagtctgactcatcttgaaaggcccaactgtgaagtcaccttttctgtgaagttttcctcaacaactttttcatctgaaagacttattcattctgttgtctgctatgtcgcctttttatgcctctgttttgtggtggttgttacagcctggttggctttattgtcagtagtgtgttggcaggtaggacaggtgtgtgtttgtgtgtttgtgtgtgtctcaagagggaagatactgtgtcccggccaggcctgtgtctccttagcactcagcacagagaccttccctcctgaaatacagggtccaccagttgggtacaactcttaggaggatgaataacagatttcctattctagatactccactccgtgttctgttttaaaataaatttattaagcagcctattaaaaatgacatagtttagagctaggctgaattaaaaccagtatataattagattttattctgtctttgtaaatgcataaaggatatcactgggtatgtgatatgaagcattccttgtgtcccagacaccaatttcatgactcaggaaatttcagcaaaaacacaaaactctaatctttccagatactgttttgttgcctgccaaaacttagacataaattgcagggggaagaaaagcattatgtccacaattaagagaattgacactttatgtgtatataatctgttactattatttgtgctcagattacagtttttgatgttcattatttcattctttcagcaaacatctgttgagtgacgaccacattccagacattgtgctgggttcagtggagcttgtagtctcatgaggaggacgtgcagtaacagttgtataggcaacgacagcacagggaaaagagtggttgactttgtgacacaggtggtcctgcagggtgaataggaactgatcaagtagacagggtagggagggtggagctcaggagacatacctgacagagtggacagtgtgcgccaagaatggagaagtaggaaatggcatggcttactttagtatttagctgtcattttcatttttaataggaaatatatattgtacatgttgtaaaatgcaaatagatcaacagtgacagttaagtcctatctttcctctgaccctcagccacacaagtcctctccttagagagagccactgttacattttcttgtaaatgcccttccacggaattatgatacatttataaacctgagatagatttttatctcccctcaaaaggtaacatgttatgcaacttgtttttcatcttgcttttttccacctaatgcataggatgtgtgtagagtggctgcattctttttaatgtaatggctatagactccattatgtgagtggacaacagtttatttagttggtaccctttggaggagacatttaggccttttataataatgtggtgtcgcctatcccatgatgtagattggaataagtgagcaacagccagactacagagctgagggttgtaaatatattcaactcttagttcagattctgctaacaaacagaaagtcaagcatgttggagaaagaaccaaatcgaattccaagaaatgcaatatattcattgaaattacaaactcaagataaagaactgaaaagacagcactgaatcctaaccactagactaccagatttaaatgtaaactatattaatcctagtagaaaacctagaaagtacccttcctgacatcagacttggcatagaattttttggctaagtcctcagaagtaattgcaacaaaaccaaaagtaggcaagtgggacctgattaaagagcttctgcacagcaaaagaaactattaacagagtaaacaatctacagaatgggagaaaatatttgcaaactatgcatctgacaaaggtctaatttccagaatctgtaaggaacttaacaagcaaaaaacaaataatcacattaaaaaatggacaatggaacagacacttctcaaaagaagacatacaagtggccaagaagcatataaaaaaagttgattatcactgatcatttgagcaatgcaaatcaaaaccacagtgcaatacccttccataccagtcagaatggctgttattaaatagtcaaataaaacagatgctggcaaggctgcacagaaaaggggaacacatatacactgttgataggaatgtaaattaattcagccactgtggaaagcagtttggagatttctcaaggaacttagaactaccatttgacctggtaatcccactactgggtatatatccaaaggaatataaattgttctattataaagacacatgcattcatatgttcattgcagcactattcacaataacaaagacatggaaccaacctaggtgcccatcaacagtggattggataaagaaaatgtggcacatataccccagggaatactacacggccataaaaaagaacaagattacgttctttgcaccaacatggaagtagctggaggccataatcctaagcaaattaacacaggaacagaaaaccaactactgcatgttctcacctgtaacagggagctaaacattagtacacatggacataaagatggaaaccatagacactgggtactatgagagggggagatgggggtgtggattgaaaaattacctgttgggtactatgttcactacctgggtgacaggatccatactccaaacctcagcatcatgcaagtatacctgtgtaacaaacctgtacatgttccccctgtatttaaaataaaagttgaaattatatttttaaaaacagaactgaaaagagaactggtgaactgaacagtggatctgaagaaattatccagaaagtgccacagagaggcagaaagaaaatgtatccatatgctgaaatactacacagcagtgagaccacatgaaccagaaccatgtgtcaatctggttgactctcacaagtgtattatggggagaaaaaaggcaggttacctaataatccataccatatatagtttaaaacatgcaaagttaaacaacatatatctgtaatactactctaagggcacagtaaacaccaaattcagtctagcagtgtccagagaatggggtatgggaatcgaaggacttgggtgggaagggataccaaggatgcttagctctcttggtaatgtgctattgattaagctgagtggtggacacccagatgtccagtagaccatttttatcctgataaattcttgtaaaatatattaaatatacaaaatagtatatgtagcttatatgcagaaaaaaatgaaataagcatgtccatactcactgcccggcttgaggaacagaaaattaccagtgcctttgaaccactccccccatgtattccttcccaattatggtatactttgcccctgaggtgtactatatctagtccttcatgtagctgatatatttcataataagggtttctttttgtttttgtttgtttgtttttgagacagagtctcgctctgtcgcccaggctggaatgcagtggcgtgatctcggctcactgcaacctccgcctgctgggttcaagcaattctcctgcttcagcctcctgagtagctgggactacaggcatgtgccactgtgcccagctaattttttgtatttttagtaaagatggggtttcaccatgctggccaggctggtctcaaactcctgacctcgtgatccacccgcctcggcctcccaaagtgctgggattacaggtgtgagccaccgcgcccggcccataataagagcttttaaggggataaagcatcttactagtatatttgataattaatttgaactcaaattttcatccccctttttaagaattgttgtgttggtcatctaagtaaaaattatatcttgtgtgcctatgataaaacttctaaacataacatattttcagcatctccccaaaatatgtgatgtttcaagagcatagtgaaaattaatcttccatctggccccatcagttttaatcagggagaaccaaagttaagtagtttcttggttagtgccttaggataataccatctacaaaagtggagttcatgtcaggaggttatatgtcagaagtctcctttggaagatcaaaaaagctcattttgatggtggtgtgggaagagggaaaaagaaacttaaaaacatatctggaataagggttagggaccctgtgttagagcaatggtaccttaacttctcatctgtaaaagaaatgtttactaattgggaggtgagatctgagttagcaatagggatgttgttgatggtctagagaagctatgtgcagtttcccaaaaagatggtgtattagtcaacttgggctgccataacaaaatactatagactaggcggcttaaagaagagaaatttatttcctcacagttctggcggccagaagtccaagatcagtgtacctgcatgattgagttcttacaagtgatgtgtacattgtgacttaaagaatggttaagagttaacctggtgaagatagttacggaggagagaatggaaagagagtccccggcagaagctcagaggaaaaactgattaatctatttcaaagcgtagctgatgtttagctgaaaatcttgacctgggtctctaaagagtgacaaacaggtcaggaaagtttgtgttcatctgtagtaacctttttaatccagtccttaggtaactgacttggatttgattaataagtttaattaaagggagaaatagacaaaacagcaataaaaatgtgttaaatgatccctcagccacaggcacactgtccttgattttgggaaatgtcagagtgtgggacagaaacaaatattcatacaactgatttaaaacagaaagctgatattataattccaaagggccttggacctaacccaggcatctgctgtcctcccattattttctgttcaaatatatctgtgatttttttttttttttgagacaaggtttcgctgtcactcaggctggagtgcggtggtgcaatcacggctcactgaagcttcaaactcctgggttcaagtgatcctcccatctcagcctcccgagtagccacacaccactatgcctgggtaattttttaatttttttgtagatacgaggtctcactatgttgcccaggctgttctaaaacttctgggctcaagcaatcctcccacctcagcctcccaaagtgttgagattgtaggcatgagccactgtgcatggcctgtgaattttattttagaagcattttaaagaaaatgtgtttaagagtacgtatgggtgcccctccatattgttgggacttgaggggtctaactagtgatactctaaattctctaccaaactgaagcagttgggagataaaggagccagatgggtagcaatcccaatgtctcatttattagtggcagagctagtagagtatggcttaggtatgtggcaacaattgacttcttgagaccgtagtcctggaataggcagcaataatccctccaggtcctgggactattgagctagcacaggccccaactagaatgaggcaagtataatcaacctacacttggataccatattgaactcagtaaaaagttcagttgtgaagcccaagtcttcctccttggttctagttttcaatgagcacctcttccattcaacattagaatgggcatgttcttttgcaaagactatcagaagaaggtatgtggtctcccatagagaaatgctgtgcagcacagcaacgatggcaagttcttcctggtgtctcacccaagagcttcatggcgcaatataactacattttccatgtctagttttcttaagtagtatataagacctaaaatcatttccccctcttattactaactgtaacattttgtatatgaggaaactacttaaaattgatggtgtattttgaatcacatgaacttgttccatcttggtttgagttaaatctttggaatttcagctgttgaagaagaggggcattggattggaggtcaaactcttggctgatgggcttgaatttcactcttttagtgtattgttctaaggggatgagatagaacttttgtcttgaagagcgattgactcaggttatttctttaattaaactcagccactgtcagagcagcactattcccaggttggtgagtcacagattttctattgtattgtcaagagttatcagtagctacctctcccccacactccagattctgagcccttttaaggatgaatttctgcctactgtccaacaaagtggagtgaaaaaaatgtacgcaaatccctttccccaagaaattattgaaaaggtaatatgttaattcttaatacttaaaagatcacgtctcagcactacaaaggtgtttaggcactggaatataaatccatggtaatagctaaactattccaaagtgtaagtcatttcacaggctgggtgtccatatgcagtaggggttcccgggcttgggagagagaacaaccagtccataaatgacaaacttttattatgatatatttatgtcccatgtactttaaaatttttaattgacaaaaattgtatgtattgtgtacaacatgttttgaaatatctatacactgtggaatggctaactctgtcagggaagttgccccaatattcacgtaggttcttttctattttccttaagcgtcggccagcttgagaaataaagggacagagtacaaaagagagaaattttaaagctgggcatccgggggagacatcacgtgtcggtaggttccgtgatgccccacaagccgcaaaaacaagcaagtttttattagggagtttcaaaaggggagggagtgtgtgaataggtgtgggtcacaaacatcaagtactttacaaggtaatagaatatcacaaggcaagtggaggcagggcgagatcacaggaccacaggaccgggacgaaattaaaattgctaatgaagttttgggcaccttagtcattgataacatcttatcaggagacagggttttgagatcaaccagtctgaccaaaatttgttaggcgggaatttcctcttcctaataagcctgggagtgctatgggagattggggtctatttcacccctgcagtctcgaccataagagatggccatgcccaggggggccagttcagggacccacccccaggtgcacattctctttctcagggatgttccttgctgagaaaaagaattcagcgatatttctcccatttgcttttgaaagaagagaaatatggctctgttcctccgggctcacgggaggtcagagtttaaggttttctctcttgtttcctaaacattgctgttatcctgttcttttttcaaggtgcccagatttcatattgctcaaacacacatgctgtacaatttgtgcagttaatgcaattattacagggtactgaggcgatatacatcctcctcagctgacaggattaagaggttaaagtaaagacaggcataggaaatcacaagggtattgattggggaagtgataagtgtccatgaaatctttacaatttatgtttagagattgcagtaaagacaggcataagaaattataaaagtattaatttggggaactaataaatgtccatgaaatcttcacaatccacattcttctgccgtggcttcagctggtccctctgtttggggtccctgacttcccgcaacataactcgagctaattagcctatgcattacctcacatacttttcacttgtttgtggtgagaacacttaaaagctactttgttagcaatttttgataatacaacacattttattaactatagttatgttgtccaatagatctcttgaacttattcctcctaactgaaactttgtatcctttgaccactttcaaaattgtattcagtttttgtaatgtagcattttatgtgtcttaataaaagtcaccttcttatcccaaattgcttcagctaggaacctggtagtcatcattaattcctccctgtttatgatctcccacagtcactccatcgacacgaccagttaggaggttactgaagaagtccaggcgaaagacggttggggtggattggcacattggccatgaccagtcctgggactctggagccagacaacctgggattgaatctcaggtccttcgtttgcatgtgacctatgtgtaaccttgggcaaagtcctgtttctctttctgccttggtttcttcagcaatgtaataggaatagtcatagtaccttactcaagggattgttgtcagtattaactcagttaatatgcctaagatgcttagaacagtgtctggcacatggtgctagcagtcactattgtttttgtttatctgctctttcagattgtaaactccatgacagcagaatatatgtttcactaccatatgtccagtttctaccatagggcctgacacatagtgggtacccaaatattttttgaatgcatgcacgaatgaagaaatattaattcatcaatatataaataaataaggaaggaaggaagaaaacagtgattgtgagctatgtttagtaagcaaaaccaggattatgatatctaatcactttcacaggatagaattattgatttattttttggttgctcctaagcacctggttggtagaagctttcatgtattgtaacgctaaacctgtaatttttcagggctggggagtgggaagggggttttcatttaaggacgtctgtgctttaagaatattttaggtttgtggtccagctgacgttttctttattttaaagttggagaggctgggcgcagtcgctcacgtctgtaatcccagcactttgggaggctgaggcaggcagatcacctgaggccaggagttcaagaccaccctggccaacttggagaaaccctgtctctactaaaaatacaaaaattagccggccgtggtggcgggcgcctgtaatcccaactactcaggaggctgaggcaggaggatcgcttgaacccaggaggtggaggtttcagtgagccgagattgcgccactgtactccagcttgggcaagagagtgagactctgtctataaataaataaataaataaataaataagtaaaaatataaagttggagaaatgagattcaaagaaatttttctaaagtcagaaatgttttctcatgtccaaagtgggataccaactcttgttatatatttcattgtgggtactcttaatatataggtttgagtgtagttcagcctctatctgattgccagcgagcaaatatgttttgagtacctagtatgccaggcacttccatgtgctaaggatacagaggggaattcaacagatcccccacaccccaccttccatggagctgacagttggaccagctaggcagaccaactgtccagatgtttataacaaagtgtggcatgtttacaaaagaggaagcacatagtgcagtgggactacaaagccttggaacctagcctagcttagggagtcagggagggcctcttggaggaggtggcatttaggctgtgtttcccattggaaaaaataatagtaaagttgcatttagatataccacctatatagttaacctgctatcacttcctgagagtcattgtatattcccctctgtttcttccagggtcctgaaggatttacgtttgtgttacatatttgatctgcatataggtattcatgcgtgtagcccttgcactacagaatatattgtctgctggtcttacatcagttcagttctcactttgagagatacttattggaaaagtatggaacactagtactggaaaaggatcgcacatgcgatctctagattcattttctcatttgctctttttttaaaaaaaaactttattgacatataatttacatatcataaaatgcactcatgtatacaatttcagtgatttttggtaaaatcacaaagttgtgtgaccatgataattcagtttcagaatatcttaatcatcccaataggatccttcatgccttagcccctggccaccatgaatctactttccatctctgtagatatacctgtcctagacacttcatagaaatggaattatacaatatgtggcatttttgtgactggctttcactgagcatgtatgcttagtgtaatatcttttaggttcatccatgttgtagcatgtatcaagttcgttcctttttctactgtatggatagaccacattttgtttatccattcatcagttgatggacatttgagttgttttcatttttttgctgttatgaataatgctagtatgaacatttgtctgcaaatctttgtgtggacatctgttttcaattctagtctagggtagagtgtaaattgctgagttgtatggtaagtttgtttttaactttttaagaaactgcaaactgttttccaaagtggctgcacaattatacattcccaccagcagcgtatgagggttaggtttgccacatgctctccaacatatgttagtatctgtatttctgataattgccattctagtgggcatgaaatggtatttcattatggttttaatctgcatttcctgaatgatctataatgttgaccatcttttcgtgtgcttattagtcattcataatttcttttggtgaaatgtctattctaatcttttgcccattttaaaattgaattatcttattatggagttatatatttatatatcctagatacaagttctttatcaaatatgtgtctgcagttttttcctcgtcattttcttaataatgtctttttttctctctttttttaagagacaggttcttgctctgtcacacaggctggagtgcagtggtgtgatcatagctcattgtaacctcaaacttctgggctcaagtggtcctcccacctcagtcttctttttttttaattttgacttttattttagatacagaagatacatgtgtaggtttgttacatgagtatattgcacccaggtagtgagcatagtacacaataggtagtttttcaacccactccccatctttccacccaagtagtccatcatatctattattctcatgtttatgtctgtatgtgttcagcatttatttcccacttataagtgggaaaatgtggtatttgtttttctgttcctgccttaattcgcttaggataatggcctccagctccatccacgttgcaatttttttgtagagatgaggtctcactgtgttgcccaggctggtcttgaactcctggcctcaagtgatcctcccaccttggcttcccaaataatgtcttttgaagcacaaaagttttgaattttgataaaatttaaattatcaattttttattttattgtttgtgcttttcatatcatatcagtgaaaaatttacctaacctaggaactcacagattttttcccctaggctttttttttcctaaaggttgtataattttaacctcatagatttaggtctttgacccattttgaactaatttttatatatatagtattaatttttatatatagtaggaggtcagagtctaagttcatctttatgcatgtagatatccaattgtcccagcaccatttgttgaaaagattgtcctttcctcaattgaattgcattgtcatctttatcgaaaatcaattaaccataaacacaccattttatttttggactctcagttttgctccattgagctatgtgtctatccttataccactaccacactatctttgtagtgagttttgaaatgtggaagtgaaattcacccagctttgttatttttcaaggtaatttgcgatcttctggtggttttgcatttccatgtatgttttaggctcagcttgtcaatttctgccaaaaaatttgctggaattttgataggaattgcattaagtctgtagagcaatatggggagcattgtcatgttagctatattgagtcttctaatttatgaatatgggatgtttctccatttatttgggtcatttcatttttctcagcagtgttttgtaattttcagtgtataaatcttacattttggtcattcatttttcacagaacgagtatttgtacaatttggattttttcatacaactggcacttagaaaattctggtgaggtgggaatccagagcttggagaagtatggcttctcagtggtcataataaaaggggcctgagaccagtgggcagaagctacagggagacaaactttgactctgtttagagagccagtgttgtcctgctgcaaaaaggatagacctggaagatggtgagccccctcactgtctgtatttaaacaagagctgtataatatcatggtaagaagcttagagaccattcgttctcatttctgagcatgcattgaaatcagatatggaacttctttaaatcaaaatacctcaaacaccccctaaacctacaggatgagaagttacaggagagactctagacacctgtactttaattggttccccaagatgactctgaataccacagtataagacctgtctgctgttgaacagagtgttttataaatgtgatggataattggacttgtattgtcccttccaacattggcattttgtagtggcatgagatctggataaaatgagtgtggggcaactgtagacatgccttaggtatgtaggaaacacaagcagagggattttccttggacaagcaggcaggacctgtggttctgtttgtggtgggcttcatatctcattcggatggttcagtgccaatgctgaatctcaagcaattctgaaaaaaatcttcctaatggtgccatgcaggtcatctgattttaagtgacctgaatgcattagagaaattgagcaataaaatcagtggcttgtgtctcacacttcaggtttagcccattatatggcagatacttatttcccattttaatgggaatttttaatagtaaggttgctagctccatgaaacctgtcttccttgcagtcttttaattcttattaaaagaaaactgatagagtaaggttgcttactttttggcctgtttaccaatctacagtgccacaaagattgatgatgatacattatatgatgatactgttttattactatcattatgtgttttgctaaatccctgggagagtcttctaaataaatcagcatttatacaaggacaattatgcctacccttgaaattttcctctggtgaaaaccctatataactgtaaaattgctgtagaagtgctcattttacaggcacctgggaagctgctagagggacaaataaggaagttatggtgtcctgtgcctttgctggacaggacaacttcaaaaacagtgagttctgtagctacttttctagagatattttttctattttgctccagcccacatatcacttgtcttcctaacctccatccccaatatgcactatttttatagcaagagatgatgcaaaggaaaataactaattctaaagggctcataaaaagcagcatttgtacagcttttgacagtttataaagggttttgacatatgcatgttctcactacattcttacaacagcccaattttagaaatgagcagcagagaggtactttgtgctggattgtagctaggtggaaagtgaagttacctacccaggtcttctgtcactgaatctaccaaattcttctccattatgcttcctcattactaccagacaaaataaatatatcaggaaaagttggtaaatagcaacaaataatgccttagaattaatttgctacaatatacaaaagcaaacattttcagtaaatttttgcttcttatacatttataaaacatggcaagataacaagcatgtaggaattctgttattcatgctcatgggaggacttctggaatgactgtgtgagagctcaataaatcttcttcccaaaacacagcaataaaattggacaaagttgtcaaaaataactatttagtctctgtaaattgatgaaaggtcaattaaattgaggaacatttattaaagaaaatctactgaatcttggtaagaatagtaggtgtctatggcatttaagattgctcccatccctgccagatccatgttctggatgatttatcacaggcaggtggaatagactgcagtgaccaccagctcccatttctcccaccagctccagaaataaaccattgtgtttatggtcagttgattttcagcaaaggtaccaagagaattcactggagaaaagaccgtatttttaacaaatggtgctggagcaattagatacccgtatgcaaaaggatgaatttggaccttaacctgacaccatacacactaagttaactcagattgtatcagagatctaaatgtaagcatcaaggctataaaacacttaaaaacataagaaatattcataactttgggttagacaagtgttttttagatatgataccagagccacaagcaataaaataaaatggataaattagatttaatctatcagagtaaaaaaattttgctctgccaaagacaatgtcaagaggctggaaagacaagctacagtctggtagaaaatatttgcaaatcatatatctgacaaaggacttgtatctagaatatataaggaacccaaaatgtataagggaacccagaatatataaggaacccataagaaaacaacccagtttttaaaatgggcaaataacttgaagaaacatttctctgaagagggtattaggattgccaataagtacacaaaaagatattcaacatcattagccattagggaaatgcaaatttaaagtatggtgaaataccactacacacctattacaatagaatggctaaaatgagagatattggcaataccaaatgtggatgaggatgtggagcaactagaaccctcatatgatgctgtaggggacagtggttaaaaaatggtatagttgggcatttgggttggttccaagtctttgctattgtaaatagtgctgcagtaaacatacgtgtgcatgtgtccttatggtagaatgatttataatcctttgggtatatacccagtaatgggattgctgggtcaaatggtatttctttgatagaatggataaagaaaatgtggcacatatatacaatggaatactatgcagctataaaaaagaatgagttcatgtcctttgcaaggacatggatgaagctggaagccatcattctcagcagactaacacaggaacagaaaaccaaataccgcatgttctcattcgtaagtgggagttgaacaatgagaacacatggacagaaggaggggaacatcacacaccagggcctgtcagggggtagggggaaaggggagggagagcattaagacaaatatctaatgcatgcggggcttaacacctagatgatgtgttgataggtgcagcaagccaccatggcacatgtatacctatgtaacaaacctgcacgttctgcacatgtatcccagaacttaaacaaaaaaaaaaagaactgaaaaaaaaaaaaggcataattactttgagaaatggcttgcagtttctcataaagttaaagatatgctgcacatatgaccgagcagtcccactctgggtatttaccttagagaaatgaaaacatgttcatataaaaacttgttcatgggtgttcatggcagctttatttgtgccagccaaaagctggaaagaagccagatatccctcagtaggtgagtgtttatacaatggaatacaacttagcagtaaaatgagatgaagtgttaattcacacaatacttggatgaacctcaaaggtgttacgctgagtgagagaagccagtctcaaaaggttacatactgcatggttccatgtatttaaccttgcaaagacaaaactgtattaatggaaaaaacaaaacaaaacaaaacaaaacaaaaagcagtggttgctggggttaatatgtaggatgaaggtatcagtgtgaagagatagtacaagagagttttgggggagtggtagaactatttggtatccttgttgcagtggtgcttacatgaatctatatgtgtgttaaaattcatagaactgtacaccaaaagaaaaaataattcattgtataacaataaagcaaaaaaaaaattttaagacaacatcagagaaattttaaaaaagaaaggaaaaatataggtcatagatttggggaaaatattttcaaattgtattttcaataagggacttctatccagaaaacaaaaagtttgggttttttttttaccattcaataagagaacctgagttaaaatatggcaagagatttgaatgacgagacatttcaccaaagaagatatacaatggcctataagcacataaaaagatgctcagcatctttaggcattagggaaatgcacattaaaactacaatgagatacctctgaacattctctaaaacaggtatgatcataagacaataacaagtgctgctgtgcctgtaaacaaactataactctttttttttttttttttttgaggcggagtttcgctcttgttgcccaggctagagtgcaatggcacgatcttggctcaccgtaacctccacctcccaggttcaagcgattctcctgcctcagcctcctgagtagctaggattacaggcatgtgccacaacgtccagctaattttgtatttttagtagagatggggtttctccatgttggtcaggctggtctcgagctcctgatctcaggtgatctgcccgcctcggcctcccaaagtgctgggattacaggtgtgagccactgcgcccggccaacaaactgtaactctcatgtgttgctggcgagaatgtaaaacaatacatttttcccaatgtagtttggcagtttctaaaatattaaacatagatttatcatatgacacagcagttccactcctaggtatctactctagggaaatgaaaacatgtccacagacttgtatgcaaatgttcatagcagcgttattcacattaacaaaaaagggaaacaactcaaatatttattgattagttaatggacaaataaaatatgatacactggtacagtggaatactatttggcaataaaaaggaatgaagtactgatacatgcctccaacatagataaaccttgaaaacatactaagtgaaagaagccagacacaagaggctacatattgtatgacaccatttatattaaaagtccagaaacggcaaatctatagtacagaaggtagattagtagttgcctgggaattggagtaggaagcaggaagtgactgcagatggaaatgtttcaaaatcagattgcagtgatgattgtgcaactctgtgaatatactaaaaatcattgaatagtatactctaaaatgggtgaatcttatggtatgtaaattgtaccttaataaaattgctttttagtttcaccacatattcaaaacaaggaacaaaaatattttgaatgaattctccttgaaactaatatatcaacgaataacacagctgcataagtagcagaacaagtagaacaaggtattgaaagggctgtaatattcactctcaaaatccaagtcatgtaaattacccccaaacctgaaaagtcattgtcaactgctggaatccattggattctctttattcattgaattagaaatagttatcaccatcttcaaacactgtgtaactggatgcaaaatgagatactttcttttcttggaatttcagatgaagctttaaaactcataacaacccctactgtgctgtaaaaaactccacagtggtggccacactgatcaggtgatcacctaccctcagtaccttacataagaaaaaatgaggtctcactaaagaacagtgcacccacgtacctgttctcctccgtaacaaaggcttattaacatagacatttaaatattgtagctgatggatggctgtctagaattaaacctcaccatgtccacttgttcagctctcctcccaacagcctcagccacaaaaggaaaactggcaccagaccaatgggagctggtttctttaatgaacccgtgggatttttaaaccacacgttgctctcatgattatattccttcatcatactaccaagttttggataagcacatacataaactatatatatgcaagtacagttgtgaagtgagtttttttcctatccacaagttgaaacagtctcgaatttttgcccctttggagtttaccatcttgttttaagccacatcaaatgtcaaaggaatttcatccatatttgctttctgtaaaagttcaaaacaattctttcattagtaatgtacctacgaaatcagtgattgtctctttatcagctgacattttatgtgctattttccctggcccaaacacacagtaggttatttctctttgtgatctagaacactaggctgttaatctggtcaaatcattagtgcttctgttgctctccatcattttttatgaatactgaactttctgaagctttcaaaaaaaaatctagtgcatgttttaattccttgtagctatgaccacttcacagttccctgtcaggatgtctccgagatccagcagatgaaaatatgctgttcatgttttctccaagtctttatcattttctcacctaattaccttcctgcagttctaatatcctattctttcttcaactggaaaacgccaaatatgaacttaatatcatgccatggaatatagtggtaataaatatgaatctaaaatgtctggggaggtacccaaactctaccttgagttagtggtgtaccctgtggcttggtatatttttggtcaaaactgtcaggatggtgttaaccttacatctctgctgtggtgttttgtgttgccatattttaaccacaagggggcagcatcaccaccttcgctgtctcccttccatctttaatatgagcgcattgggcccagggtagagaagaaaaggttttacaactttaaaaagcaatattcgtcatctggtgatgattgtaaatatgatagtgatgattactggaagagagttgaagaatgtttcctctaattgaggaatttgtctacaaatataaaccctctcttgttagagtagtattcatgaggacctttgctagtatgcttcagtctttccattagctctgctaataatgaggttagaaaagtcaagaaacaatgagttacatgaagcaggttctgatttttaggagaaagatagtctgtaaatgacttgttttggcttcctgatgacaatttaagttaaatcatgttccaaatagctgcctccagatgctgcagatcatcctgtattatgatgagtgttgaagggctagagtcgtctttgccatgtaaaacttcgtcagaaaataactgtctaaccagggagtgaaataagactaaaaagcatcacagagttccatctagagtggagagagagccccccagagccctgaacagctccactgccaccaatctcattaccatcacacctgcaaaggggccactgctgccacagctggccccagtcaccattactgtgaccgcaaacatgagcagtgaggctgagacacttggcatgacaccatgggcagaggcagagggagtggcagcctgcaaacaggacaagaaggttatcccagtgaaagtttgggaacagtaagatggttcagtgtaagaaatatatatggtttcgtccacaggaatgacactgggtgagatgtatttgtatgccagattgtcataaagaagaataacccccaggaaacaccctggcagtacaggggatggagaagctgtggagttcgatgttgaaggagaaaacggtacacaggcagcaaagattgcaggccctggtggagttccagtgccaggcagtacagatgcagtagactgaagccattatagatgttatctgcatcatgggggtcttccacacggtcaccagcacaattaccagaacaatgagagtggggaaaagaaggattggagagttcccttaaacgtcaggccttacagcacacagaagatgcctcctcccttgcagagaccctatgattcttgaccagagtgttctaaccctcctgtgcagagacaagtgatggagggtggtgacaaccagggtgaaggagaagaggtaggtcagtgagacagattacgtattggggttacagaccacgaatctccagggcccctcctcacctagaacagtaatgaacacccaaggccagcagccatgtcattgtaggcaccccccaacttcagttaccagcacagacacccagaaaaccctgaaccacaagatggcaaagagactgacagctaggaagtccgttgccaaggctgagcagagcaggacagagtaaatgccagccaaccatttctagtgtcatctggtttgtcatcctacaggaataaatgaatataaattccagcaataagacctgaacaaaagattggttctgaagaccttaagtgactgcttttggcccatttaccagacagctagcactatctgagttatggagctttcattacttttccctacagacatctctttttggtaatgataaatatgtttttttaaatatgttttttaaaaggtctggggccaggcatggtggctcacgcctgtaatcccagcactttgggaggccgaggtgggtggatcaccagaggtcaatagttcgagaccagcctagccaacatggtgaaaccccgtctctactaaaaatacaaaaattagctgggtgtgatagcgcatgcctgtagtcccagctactcgggaggctgaggcaggagaattgcttgaacctgggaggcggaggttgcagcaagccgagattgcaccactgcactccagcctgggtgacaaagtgagactctgtctcaaaaaacaaataaaataaaataaaaggtctggtttttcttatatgcctttaaaggttttcaaattgtttcgtatctggtcagattgagattattaagaaactcatttttaagttgtaaaaaaaatcaagttgttttattacaagtcaacaaactgcaagtatctgttaatatgggtctataataattataataacacaacacagatgcagattttggctcaaagaactatatttttctagattttatattttatttgctattcaacaatgtcttgtgagttcttatatatcttggtgataagagacattatagaacattacacatggaagacagtaaacatcgttctttttctcagcaactttctccattaatggcaaaatgagatgaggaagcaaatatatcattctgtcttttaatattgccagcaaagaactgaatttagagagaagtctgaaattttccttctagagaattatagaaagtgtctgatagtgatttatggctggttttttgtttttgttttttaatctttcactcacttttacttgggcatgtctgactcgtgttcaggtccagggagccacactccttccttattcacagaattgaatgcttatacatgatcttgctgtttttatttttcctaatgggagagccctactaagaagggtatgagacttacatacttgtagctgatgatcttagccatctcatagctacagccccaagaagccagctctccagcccctgaatcctgactcctcaaatgtacactgcagtgtttcacttcccaaggggtgtaattaccttctccatgataccagtgtttcaaatgacctaagcaaaagaatttcttttttctcccctttcctctgatgtgtggcaaagcaagttacatttatagcaactggaaattccagtgggctggtccttgctggcacatggcaacaggactggcttgagggatgctgctgagtgaaatgaaagagctcagcagttctgctttgtgctgtcctggccagaaaaatctttgctgcttgtcatcccatcttcctccactagaagcctgagaaatgagacatgctcaggtgttaaaagtggtcacagggctggctggatgtggtggctcacacctgtaatcccagcactttgggaagctgaagccagcagatcacttgaggtcaggagttcgagaccagcctggccaacatagtgaaaccttgtctctactaaaaatacaaaaaaaaaaaaaaaaaaaaaattagccgggtgtagtggtgggtgcctgtagtcccagctacttgggaggctgaggcaggagaattgcttgaacctgggaagcggaggttgcagtgagcccagatcacgccactgcactccagcctgggtgagagagcgagactccactcaaaaaacaaaaaagtgctcacagtgtcataataccactgaaggtactgtcccaccttgtcctcctggtggccgagcaacttaaatcggaccagaatagatggatgcttaaccctttcaatcctgaaggcccatgcagtttctcctaaaatacataccccatgcccagtttctaagattactgctgcatttcttagttgttgaaagtcaactatgccattatttccacactttctctatccttcctcaggcctgatgagtttttttccactctttcagggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtgagctggggacactcagccatccttgtcctgacatggttgttgattccctgacttgtcttgaccttgtggagagaaatccttccaaactcctggattatccgtaacattcctggctctctgttttgttacaaagctttttggtccatgatgaggagaaggaagaaccagatcttcaacttgagcctttcagctggtgacctttgtgggtctgttagcatctgtagctgaaatgggccactgattgtgcaatggatttgtacgtccccactcagctcatttatccagccaccatctcctctttgctatgtctcttatccttcctgtggtttagggatgatattgctactttcttaaaataagattgatttcacttttagcttaatttattcagtattcagaagggtaattcttagttcttcgtggttcttttgctatatcctacaaatatttgagtgcttactcttatcagtgattgatgccagaggcttaatgaatcttcaggggaagaagaagatcttgttgtcttagaatttgagtccaagcattttcatttaatgttggggtagcaacatagtccacatgaaaaagcattatacatcttgcatgggtaatttccaggataagcaagagatctgtattaattgatgtatactccattaccttatagaccagggtttatcagaaggaagccttctgtatagcggtcttgggagatccaggttgtggggagcccattttaatacagcacaaggctaaggtatgtgaaggctgacagtgaaaggcagagtgtagcctgtgctccagaaattaaattattgttgtttttggaatctaccctaatccttaaggaaaattattctctacctggagcattaaacatgaccatcttttctgtgtccctaatggcagcactctttgctctcaactcttcataagaaagcatggggttttcataaacattctgaaattcagcgcaactgagaatgaaatccaatgtaaataccacacttaatggctgtttggaaatggcagcttgagcccttcatattggataagatgggggaaaagggaaatgataccaacacatttccatctttcaggtcataatagaagatgaagctgacttttgctctcttatctttagaaacctgtttatttaaatcccctctgtttaaaattttgctgcacaaagcaaaggtgggagaacaaacaaggccaggatgattgttgctagttgagggaaaagagacatgttgacatagcttggttgataagaagagcattggactgagtgtcagaaaacccttgtgctagtttgtacattattgggtttggtggcatccagcaattttcactgcctttgggcccagtgtcctcatattgggtaggtactgtccaaggctccttctcattctgacattccctgctttgcagaacactcttatctttaacaagaagagagaataaagcatcatttgaaagaacctacttttattaggctgattaacacctccagtttctaaacaaataagttaacatttaataactagaatgaaggtttaaaaataattgaaacacaagccaaataatctaccagcgtgaacaaattctttaaaaagattagcatgtttatagcatgcttaatttttttctggatatgataaaactttgttctctaaaagtttcagagtaatttgattaatttccctgtatcaaacctacaagaaatttcagttcctttaaagttgcccaatttatgctgatgttcaggagccactaacatcactggtgactttgatttaggctacatcaagtgtcacagaaggctggtcactcaaaagagacttaaattcagcacaattttgtctataaaggattctgtgaggggatccaggaagttaataaagaatcacgacggcatcttttactgcagttgagtctttataaacgtgtgatgaaaatcaagatttttttttttttttttgagatggagtctcgctctgttgctcaggctggagtgcagtggtgcgatctcagctcactgcaacctccgcctcctgggttcaagcgattctcctgcctcagcctcccaagtagctgggattacaggcatctgtcaccacacctggctaatttttgtatttttagtagagatggggtttcaccatattggccaggctggtctcgaactcctgaccttgtgatccacccgcctcggcctcccaaagtgctaggattacaggcatgagccaccgtgcctggccaagatgtttttatgaaaaacactggccagaagctttctgtgagttctcaaaattgcatgaaactgttgtgtcttattatgttttaaaacagcacaagcaagatcataagagcaaaagtgttatggggagaagagcatgccagtccatggggagtcatagcttctcctctgggataagtccatgatttttcacatttatgttgtttgctctaaatattcaaactttagtcaatggcttcaaatattaagcagatattatagcatgaattggagttaaataaaaaattggcttttttttctttttaaactttcaggtaacattcgatccagaagtatttttcaacattcttctgcctccaattatttttcatgctggatacagcttaaagaaggtaagatgtttttgccagtatttctgaaatcatgtgaatctctgtgttaatttacctgcataattttctagttatttttcttctcccagattgcttattactttgttctgcacccactcagagactatagttgacttctcatcaatgattcatttctgttttaaaatctggaactcccatacattgccagtgggaaggtaaaatggtacagccactctggaaaacaagttggcagtttctaataaaactaaagttgaaattgccatatgacccacagtttcactcctaaggatttatcccagaggagtgaaaacttatgttcacgtaaaaacctacacatgatcgttcataccaagttgtaatagacaaacactggaaacaaccaaaatgttctgtaataggtgaatggttaaacaaactatggtatatccatgttgtaga

SEQ ID NO: 1207 - DNA, 41919 bp, mus musculus; identical to SEQ ID NO: 196

SEQ ID NO: 1208 - DNA, 41919 bp, mus musculus; identical to SEQ ID NO: 196

SEQ ID NO: 1209 - DNA, 3231 bp, mus musculus
tgattggccgcactagcccgctcgtcacgctcttttgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctg

SEQ ID NO: 1210 - DNA, 27010 bp, mus musculus
ggcggcagagctctgagggcagcccgcgcgcgggcagacgaacccgcagtcgcgagctactaggcagccgcggtgagctcgccagagcctcaggggatcgaggaggtcacggggcgttggcaccgggtcgcgcgccagcgttgccctcttagcgaggacgcttctgcgcgcggtgagctcgacgcgagccattcaacagctggcctcgcgagcgacagtcgcacggggtgactgggaccgctgacggttgcgactgcggcggttagagggaggcgacgacggcggcatagacgttggcggcagcggcagggacggcggcggcagtcccgttatcctaccggatcctggagtagagacgaacggttcctgaagctcccggtaaatgccctcggctctgtcctcagaggaggcagccacgctgggccttcggtagggactggggaggggctgcgcaagagacccgagttccccgcttgccccagcagagtcacgttttccagagtaacgcctaggctcttccaggtccactctcccctcactcgagaccccgctgagccagggagcgcaccggaacccactcgagggctcacccaggccgctgttgggcgaaggtcgaggcattcccctgaggcacgttggcagtgacatcccgctaatgggaactgaaggtgccctctcctgctcgaccggtacgccaagtgcccatcattagcagggctctgccgctgccgccccctgatgaccctcgtccttggctttagggacttctcaagagattctgagtctcggcttgaggtttccggcggggtggattaagaccgttttaatctgactgtggcttgctcacccacaacgctttcgggatgcaagatcctgagcttgggttggtgggccgagaggcgaggggaagaatcaagttggggaggcccatgctgtaggatatgcatgccatacccgcactcaggggaaatcatagtcgtggtccttgggacccgtgccgccttttggtctcctgctttttgtgtttttatttaaagtcgaccattacaggaggcagaactttctagtgctgctaactccgaggggtaacaaacgtgtattggaacgctgggttccagtatgggaaactggttaccctttgggcctcttcttggtgtcttttctagattgagaatatgatctcaaagatcatgcccatttcgccctgttttccggcctatgtctgatctaaccttggaacttcatgctgttgagagtgtaaacttgtgcagtgcaatcggtagggctcgttcttcatgctaagaaaaccattttttggaaaaatatgttgggacctctcaaattctggttttttgtttgtttgccttttgaagcatgtgacattccagcagttacatttttctgtgctctggttttttgggaggaggggagagaggcggggggaggggagagaggctgggggaggccttcaaagaatggagtaacttgaagcatggagtaacttccatgaagggatttttccttcaacccttgtggagcacagaggaaagtgactagtggaataggcctgctggcaaaggtgcccggaggatcccagctgccacacacatcaggatggatggggctgacttgaggtggagtaacattgggcaggagggggacagggcctgcagagtccaccttggcttttgtagtggctttccattttgttccagccaaagagtatacctgcagtgcagcctgtttgtccaagttcccatcatacacttacgtgaagagagtggcctttgctggctttatgtgtcatctctacccacagtaagaaaggcgaggtacagaggttagagaacatggagatgataatggtggtggtggtggtggtggtggtggtggtggtgatgcgtgtgtgagagagagacttattccaaacagtgaagcagtttatcttcccagcatgcattcctacctttgctagagagagagagacttttgctgagttatttcagagccagggcgctggtagttgtccaactctctgattcagtgtacacttgggtctgtgggttctatgttgtatccaacatgcttctggcactttaagaagctataaaaccaagctgtgggctgaggcaggctaatgcctggggcacagagcaaatgtggacatcatggaatctagttgccctttgctcagaagagacagcgcaagggctggagcacttgcagaagaagaggaaggtcagtgaaaatttggtagtcataataataatgaaaatttactgaacacttactggaagttaagtactttacttggatcattttaattaatttatttattttgagacagagtttcactcttgttacccaggctggagtgcagtgcatgatctcggcttactgcagcctccatctcctgggttcaaatgattctcctgcctcagcctcccgagtagctgggattaaaggtgcacgccactacaccctgctaatttttgtgttgttggtagagatggggtttcaccatgttggccagggtggtctcgaactcctgacctcaaatgattcacctgcctcagcctcccaaagtgctgggattacaggcgtgagccactgcacctggccacatcattttatttaatcccacctgtaaggtaggcactattatcatcttctgaagctcaaagaggttaggtagcatgcccaaggatgtcaccaagctggtcagtggcagaggcgggatttgaacccagatctgcttgacaccagacctggagctcaaaagcattttggtttttactgtcacagagaaggttgcataaaagaggtgaaatggagcaaggttttgaagggtgagtaggctttagatgaggagatgggatatttggctgaggggatcaacatctttaaaggaactcaaggaagactggcccaactagaatgggggatggacacacgggtgtggtgaaaatagggctggcaaggtgggtaggatcatgttttggagacctttgaagggaaactgttacctgaagcagtaagaagtgggggatgttgagaattttggggcaaggaagagcatggcaaaggcagtatcagtcacctggtgtgaccagcatgtgcctctctcatcctcattctcatttctcattcttgagaaccttacccaatggtagcacatttagacattgtttttggatttcctgaacccctacagagtagcagacatgtgcaaccaaatacattcctgggtccagtgtgcagaaggaacacgctaggggccctgggtcaaactcagccttagatgagtgtgctgcggcctgcacaggatttgaaaaagcaattgaattagtggtcaatgttgaaaaagcaaaagaactcagtaaggatcaggatttccagcttatcttgaaatgctggaaggtctggtctgcatttcacttgtggagggcaaagctgtgcagaactgacttctttagcaaggggcaggtgctctgctttcccatggtcctacccagtccccagcccccgtgcttagtacctgcctaatcctgtaggccctgggccactgctcaagggaaacaagcccccacttgggaagtttcacactcaggattagcttcttgtcttattgtgtaattaggaaattgtcagacatgcagtgaaactgtctctgtgaagggtgaataatcttaacacacaggaatgctgtgtacctcattgtggagcattatccatagatagtagctttctttgggcctggggctgaaagcccgctgtgctagggccccaaagagacattctggtgggccttgctgttcttcatcctttgcttgcactcaggttttctgtttgctgaatagttgatgtgtataggatctgggtcaaaaagatttaaaaaaaattgcgggggggggaaaaaaccccgaagtgactacctaaaagatagcatgttaaaaatattaatctggagtcccagaaagtggtccatacgttttagatgggcaggtataagccactctgtgttggcatttgaggtgcggagttctttgttgtgcaggtctgtttaggaacttcagggcagttagcatcgctggccccttgcttacaaaatggcagtggtgtcctccctatgctagttattgtgacagctacaactatttttatgcatgtcccaacactcttgaagggagcaatactgacacacttaaacatgactgtagcctattctcaggaattttaacactcatgtgaaagaatgttaaaaccattattgcttgtctgtagcccaaagtaccaaatgtctctcctgacattcaccattttcttccttagattccagttaattgtctcaatttctttccctttctagactcagttgtttgagggtgactcttcactgtggtccccaaactgtcttaaaggtgcttggtaggtacacttaaattaatctcaatgttcactgattaatgttaataggtctaggagtccaaaagaacaagcaagtctgcattatcatttcactgtgggtctttaggtgctgttattagtattttaagtagggaagtaatacttttttttttttgagacagagtctcagtctgtcacccatgctggagtgcagtggtgcgatcttggctcactgcaacctctgcctcctgggttcaagtaattctcctgcctcagcctcctgagtagctggaattacaggcgtgcaccaccacgcccggctactttttgtatttttagtagagacggggtttcaccatgttggccaggctggtctcgaactcctgaccttgtgatccacccacctcggcctcccaaagtgctgggattacaggcatgagccactgtgcccagccggaagtaacatcttttaaatgtagttattgcacaaagtctctgttttacataagatttagcattattaagttcctactatatgttaggtactgttctaggctctaaagatataatggtgaaccagacagatgcagattaaaaataaaatgttaacaatgacacaggatgatcagatggtttctgtgttacagtgaaaataaaatggtatgataggctaccaagtcacaggggtgatagcagtgctatttcagagagtgtttagggcaggcttctctgaggaggtgacattcaagtcaaatgagagcaaagtgaaggagccagccatgagaaaatcttgaaggagaacccttcaggtagagggaaccacaagagcaaaggcctgaggagtgaacctgatgcatttgaggggcagtaaaaaggccagtggggtgagatggagagaacaagggtaatagggagaagggtaaaaagctgagttgaaagaggtgggcgggggccatgttttgaaggtaagtagtttggatttcattcaaaacatgatgagatgctgctggagggttttgaacagaggagtgacatgatctgatttaggtttttaaaaatatgacattggctgttgtgtagagtagactctgtaggggcaaggatggaagaagaaggaccagttaggaggctgttgcagtaatccaggtgagagatcacagtggcctggactggggggtagcagcgaagatggagatgaatttgggatttgtggtaaaggtggagtcaaaaagacttttggaaggattaactcctaggttttgagcctaagcgcctgggtgcagggtggctctacttagggagctgggaatcactgggaatcaggggagcaagtgtgatgtggaggacaggtttaggagatgcaaattaagggctctgatgcacttgttaggttgagatgccaatgatacattcaactggagacattgaataggcagttgaatatcaatataaaagttggctggaactacagcctacataaaattaaatgcaaattaaagctgctttaagttgtcattttatactaataaaggtaacagaaataaaaatgataatgatccagtgtgatcaggactgcaggggaatcaagtatgttaataatgctgatggcctaataaattggcttttaaaaaatatttacataagacctggaacggtggttcacacctgtaatcccagcactttgggaggccaaggcgggcgaatcacttgaagtcaggagttcgagacaagcctggccaacatggcgaaacctcatctccaccaaaaaaatacaaaaattacccgagcgtggtggcatgtgcctgtaatcccagctactctggagactgaggcatgagaatcacctgaacccgggaggcagaggctgcagtgagctgagatcatgcccctgcactccagcctgtgaaacagagtgagactctgtcacaaaataaataaataaataaataaataaataaataaataaataaataaatttacacaaagatttccatggtagcacttgttctcataatagtagtgtagagtagtggcagtactcttttggaaagagttatgctctttcaaaaataattgaagacacaaatccccagggagaatatccaactaaatatatagtaagtatagagtttctatagaatttttctctatatagaatttcttttttaacaacatttaatttttattgacacattgtaattgtacagaatttcgagagaaactctctataggcatgaaaaatgaggaattgtgttgaccatatcaatatctggaattgctaataaaacaggtgcaaaaatcagatcatgatggtatatacaatggtgtaaatcttacatgctgttcatgctgaatattgttaatatacagttgtcttaattttaaaataatttcattcgcttttgactttgtacctttttctctctggcactattccctggttaggatgccataacttcattttggtccactgtgaagagttcaagtgaattgtggcttctccagtctttcttcccttgatcacattttcagcacgaggtattggataatatcctattctgtgggacttgtattcaaataagtttaccttgggatttttaaaaggttgggaagtactgttactctcaaaaactgtgtaatagtgcaaagcagggtcccgtgtgaaggttgcttttgacctgtaggtggcgactggtgggcaggaattttgctggtaattttcagattgtggaaatacaactgagaagcaaaacactggcaacctcatgatacgcatttcccacaaataatactgattattcaatgatggaggcaaaagtatggaagatactcagccacattcctttaattccctgatagctttttttttttttcatgagaagagaaagcagtgagtcttcttcagtagcattgtttattaatccaaggtataaagcagcattcctggctggaggtgtctggagagaggtgttcttcaataaaaatgttcctggtgcagaagaaggggcaaaagaccaaaggactggtcagataggtctgctgactgctctgtgcaggtttttaaaaatagcttcttcccttgttatcttggaatgactcctatacacactagcttagagttagttatgtgaatgcatttgcacagaaaggccaacacaagacttttcttcaggctaatttattttctattagcctcagaaacactcagaacactttgcttccacaaacattaccacatacggaaactttaggatgatgttttaacacaaggaaaagaaaacaggaaattaagttgctcagagttaaattaatgtgaatccagctttcttcatctcaggatcaaaattccacatactaaattctaccttcgagctgattttctttgaatggtggtagaagagattctctctcagtaggactctaatatttcattgttgcaaatttatcattgccaaatggctgtgcatctccaaaaatcccttccattctgcccagaaagcccccagtgcccccataagcccagaccattttaattttggaattcggtcatttgtcgggccatatattggctatattcttattattgcaaaactgagtgccactcattttaatgatgtgatttttaaattattcaagatcagagcatatggtcagcctcagttttaaaatgttgttgggctaatggcgtgtcagaatacttgaacgtccatgcgtggcatcttgactgaagaaccatggaatgtttttatttggtcaagatatactgggattctgtagtagccagaaaattgaaaattggctaggttaatttgacccaaataaattctggcttccctgctatttccataaatatgttgtataattgcatacatcttaaatgttttcaaaatgactaaccttaaaattcaaaagcctggagaaaaaagaaaggcagcaaagagctactttgaaagaggatattgattgcatagatggtcctattttttccactttttttttaagtacctcattcaaatggcctttctaatactatgacagcaaatatttatgagagtgagaacaagcaagagagaatgaataggtggctactttgctgattactcaagtgcttttaaagtttcaagttatatttctgatctaaaaatcctgagatatattaggtgaatctctccagtatctcctgaaacaggagaagatattggaatgtcttaggatgcagactgtgcagaatttactgaggtttcactgctggttaaaataaacattttaggcttgtgacaacatctccagtctatttccttttctctattcccttatcctactgttattcaatcaactttgctacgagatatagaggcaaggaagatgaggtgaccgtgttctctgagaatctcctagaaatgttttggcattgggaacatgttgagtgaaatgttttagtgaagctacgtacacaagatactgctagaatgcacactgtgtaaacattattaaataactataattttttaaggttagaggagctcccattttcctatgcaaagatattaaagaataagtcatctcagtagtgttgcttttaatcataaggctaaaggaaagatatgtgcatgtgggtggggaggattggggaggttatggtgaacacaatagaatatgggaatactagaaatatttattaaaatttgactttttgataatttgtgaaggtcatgattatggcatttcttgccattaaggcttggtttatctaggctcctgaaactttgtttaataaattaatctatgcatataatagtgattggtgaaaatgatgggaaagttattaatgaattctaccattacggtcaattgaagcacaggctaattaaaagggaaattagagacaaattaagttgttctaaagagtcagttttaagtcaaagcctaataatttgatcttagtgattccacacattttggtatgtatattttgatgaatatataaatatgcataaaatacataactatatctacagtataataactaagcatagattatgtttttgtgtatttggcttaaacagggttaaaaacaaggattgtgtaggggagaaaatgacaatcctttttttttttttgagacagagtctcgctctgactcccaagctggagtgcagtggcacaatctcggctcactgaaacctccgcctcccaggttcaagtgattctcctgcctcagcctcccgagtagctggcattacaggcgcccgccaccacgcccagctaatttttgtatttttagtagagacggggtttcaccacgttggccaggctgatctcaaactcctgacctcaggtgatccatctgcctcagcctcccaaagtgccaggattacaggcgtgagccaccatgcctggactagttgagtattttccaaaaacatctgtttgcttttgctgtgttataaattatcatttatgagttaaacgctgcagctaagccaggagtggtggttcacgcctgtaattccagcactttgggaagctgaggagagagaggtgagaggattgcttcaacccaggagtttgagaccagcctcagcaacatagggagacccatctctacaaaaaataaaaaattagctagacgtggtggcacgtgcctgtagttccagctactcagaaggctgaggtgggaggatggcttaacgcccaggaagtcgaggctgcagtgagccttgattgcacaactacagtctagcctgggggacagaacaaacccctgtctcaaaacaaaatattttgcagctagatcagtgattgatgagggtagggaggaaatgtggagggacaatgggtattttgactaccttgattgcagtgatagtttcataggtgtgtatacatatgtcaaaatttatcaaaacatacagttttgatacatgtgtagtttatgttatgaaatctgtagtttattatatattaattttgcctcaataaagcagttctaaaagataggttctgcagcccattgtgtagctagtattgcaattgccaagtgagcctgtgatattcaaagtcctgttctgatctcccaggcttccatcgtgactcacacaaactttgactatgggttcaaatgcctataggcatttacagagatggcagacagaggggtgcttttggtgggtgaagggagttgctattgtattaatctgttttttttacccttttctggacaagttggtgtcagcggttataaattgcttccttttagtagcttgttattatcatctgaagttcctctttttagttaaacaaagtacaaaattaatacattcttattgtaaacattaaaaaactgaagcattaagaaatgtacaacatgggcatatagagtaaaataatagattggagactccaaaagctgggagggtgggagggaggtgaggattgaaaaattacccactgggtacaatgtacactattcaggtgatgggtgcactaaaagcccagatttcaccactgcacaatacatgcatgtaagaaattgcacttgtactctctaaatatataaaaataaatttttaaaaaggaaatgtacaaagtatttaataaaaagggaaagtttattcttctcctatagtcccaatccattttctaggggaaatattgttaacaatttgatgtatattcttccagacattatatattatgtctgtgtgcatggccatgtgtgtttatattacttttataagagcaatatcatatgttactttattattctgtcacttgctttttattttttccctaaaaactatcacaggcatccttttttgtcagtaaatacagatccactgtctggctccctacctccctccctacctccaaaaggtggaagggtgggagggaggtgaggattgaaaaattaccctttgggtacaatgtgcactattcaggtgatgggtgcactaaaagcccagatttcaccactgcacaatatatgcatgtaagaaatctgcacttgtactcactaaatatccaaaaataaaattactccctccctctgttcccttccttctcctcctcctcttcctcctccttcttctcctatatattttattagcttttgacttgaggtctccttaaggaagaagcatcacaatgggagttggttgttgtgcacctatgtaccagtcactatgctagttaatttttaatgacttagaagaagttgccaatgacacttctatagcaatgaagccatgccgtatataaaaagcttacttcttggtcatactaggtcctcaatattttttaaaagtaagattagagaattagccctctattttgggagagtaatttaagatgaaatatttattgacattcaattttaagatctaaagcctgtgaaccactatgaaagatatgagaagaacaaatgcctcagtttcttgtcatttttgtccttgggaaacaggaatttaagttgtgaggattttaaaggaggtcagttttttgtttttttttttttcaaaaacaattgggtcttcttgggaaaatcagtttgttcttatagtcatccattttatccaacattcttgattatacataatttgtgataatttctaaatatcaaatccatgataaaggaatttagaaattggcctccatgaagctacttaaaataatgtaacccaggctttgaaatcaatccaagagaagcattctacagtgttttaaacaaaggcagtattgctggagcaagtggagagcttgacaaacctgattactttgaagagagtaattctgttttgggtgaatattttctggaatttttttaaaaaaactattgctttatattaggttgtataaataaatacctaatggttataaataaattttagagttcagtatatcttaattgaatatcacattaatttttctcctagagggggcttagtgttgactcttattgcaaattgcagcaaactaactggattttttccattttgctacatagataatgcttttggagaaagaaaacatgtttcttctcatatcatcccatttcagtgttgctgtcataagggtttctagaacatagtatcttagatactgcttttgatgaccttttataaaatcagtctctacaaaccttgccttctaaaggaagttaacttggattgtcctttaagggtagttattaaataattctgtacctataaagttagccaagatttcgcagtaaattttgtgttagaatttctgtcatctggccatatatgtttggctctaaatttccctaaagttgacgttaatgagaaattctggtgacatagagtctgaatatatctgctcagaaaaaaactcctttattaggaagtgctatttaaagtaagcaaatagaagcttaaatctctaattcccagcattagtgatcttgttcaccttagtactgcttcaaagagtttgttaatatgaagtaaacaggaagcactcatgttttggggtttttccagtccccaagtagagggcaaattcactttgtcactcattagaaaaggctgtctcttcttaactttaacttagagatcaatttagttaaagtcaacagactggaggaacaagagtagatatgtccattttagacttggaaaccaacgtggacaagggatgctaagtcaggtgcatgggttagaactataagttctatgtatgttcggtgcatgttcattaatgtgccacccttgccctgtttgtgtaccatccccagcagatttttaatggaactttacatttaagatcaattgtacaatagattagagatttagaaaatcttggcttctcaatgtatgggcaagtcatttaattttcctgaaactgtctgaatttccccatctgtaaaacaggcaggcaaatacctactcacgggttgcttcataaatcaaatgagataaagtaagactactaccactaatagataatattataacttatgtttattgagaacttcctgtgtgccaggcacattctaaggatttcacctgtacacactcatttaattctcccccaaatcttattatctctattttatggttaaggaaactgagacacagtatatactctttgaaaactctaaaaaacattaaatattattaagtaaatattacatattattattattattcccttatagaacagatattattatttttaataggctttattttttagagaagttttaggttcacaagaaaattgagcataagggacctggcgtggtggctcacgcctgtaatcccagcactttgggaggctgaggtgggtagatcacctgaggtcaggagtttgagaccagcctggccaacatggtgaaaccctgtctctactaaaaacacaaaattagccggccgtggtggtgcacacctgtaatccaagctactcaggaggctgaggcaggagaatcactggaacctgggaggcggaggttgcagtgagctaagatcacgccactgcactccagcctaggcgacagagcgagactccctctcagaacaaaaaaaaaaaaaaaaaaaaaaaaagaaaaaagaaaaaaattgagcagaaggtagagaggtcccatatactcctgctcctacacatgcccagctttccccatgattaacgtctcccaccagagtggttataggtgtgacaatcagtgaacctacattgacacattatcataacccaaagtccatagtttacattagggttcaatcttggtgttgaacattctgtggttttggacaaatgtataatgacatgtatccatcattacagtatcatgcagcatagctccaactgccctaaaaatcctctgtgctcagcctattcatccttccctcccctctagttcatggcagccactgatctttttactgtttccatagttttgtcttttccaaaatgttatataataggaatcatatagtatgtcaccttttcagattggcttctttcacttaggaatatgcacttaagtttcttccacgtattttcatggcttgatagcttatttctttttggggctgaataataatccattgtctggatgtaccacagtttatttatccattcacctactgaagaacatcttggttccttccaggttttgacaattatgaataaagctgctataaacattatatgcaagtttttgtttggacataaattttcagttcctttggagaaataacaaggagtgcgcatcgctagatcatatggcaaaagtatgtttagttttgtgagaaactgccaaattgtcttctgtaatgactgtaccattttgcattcccaccagcaatgaatgagagtttctgttgtaccacatgctcattgtgatgcttcttccttaaggagacctcatttggtgtggtcagggttctggattttggccattctaataggtgtgtggtggtatctcactgttgttttaatttgcattttcctgatgacgtatgatgtgaagcatcttttcatatgcctttttgctatctgatatttcttctttggggaaggtgtctgttagggctttggcccatttttaaatcagactgtactcttattgttgagctttaagagttctttgtatattttggataaccgttctttatctgacatatcttttgcaaatattttctgccggtctgtggcttatctttttattctcttgacagtgtgttttgcagagaagaaattttaaattttaatgaaatccagcttatcaattatttcttttctagaatgtgcctttggtgttacatctaaaaagtcattgcaatacgcaaggtcttgtggatgtttaaatgttccagcaccattttttgaaaaggctatctttgctctgttaaattgtctttgctcctcttttttaaagatcagttgactgtatttatgtgggcctatctgggctttttattctgttctattgatgtatacgtcttttcttttaccaaaccattatcttgattactatagctttatagtaagtcttgattttggatagtgtcagttctccaactttgttcttcttcaatattgagttagctattctggatcttttgcctctccatataaactttagaatcagtttgccaatatctacaaaataactcactgggattttgattgggattgcattgaatctattgatcaagttggcaagaactgacatcttgagtcttcttattcgtggaccacatatttagtttttcttttccttgtatagatcttgtacatattttgttagatttctaactaagtatctcattgttttgtgtgctaatgtaaatggtattgagttttaaatttcaagttctacttgttcgttgctgctatataggaaggctattgtcttttttgtattaaccttatattctgaagccctgctgaaataacttattagttccgggaatcagaagatattattttaattctgcttgtagtatagctttccttatcaatttgttctaagtccagcaatgccagcaccatttcacaatccaaatctgtgtattactccatctgtatcaaaattttctctttcgttctctaaggtggtctgaggacaacatgacagtcacagtggtgtatgataactctgaggcaacagagctctgtgcagctcagcacctctacctcaagcccatagcaaaattgttgatcaacatattgcttccagggagtctagaacctgtaaggcccttctctaactgggaagttcttgaccagctgaagagcctgatttgccctgaccagttcaccacagttcagctctccaagagtacaaaggacttcattcaattggagggtgaggctgaaacccgaagtttggttcagatcctgaaggcaaagttacatgggaagattatcaagctaaatggtttgaaaaaacacttaaaagtagtggctacagatgcccagggagaatgggagcacttccccaaggaaaaagagccctcgttgagtgatggggctgaagagcaggagaagagcccagattccatatgttttgaagagttgccctgtaaatggtttgcacctaaatgttctagcaaagagaagccatatgaagagatcctttgggtagtctttgaaagttttgggaagatcaagaatgtggatatccttatgcttggcccctacagagaagtgatgactgacaggagctttgggggttttagctttggcttacagacatttgaggcattcatacagtaacaagaggcaactgactttgtaaaagccatggagtccctttgaagaatgaaactgatgcttaaaggaaatgatgggaaagctctggcatgtaacattaaggtaagaagtagccagagtttcttttattttccactgttcaggtgatcctgaataaaagctggaaggaagcatctagaataaattttcttagaccctaccaggctctgatcaataactaatatataaagacttttattatttttaataaatggatgtttaggaagaaaaaaatcctgatttgaacactcattcttgtgctatcaggcatgctgccagctatgactttaaagtgatggttcttataatctgaggttctgtctcaactacttgagggcattaaagaattcttcatggcccctatggaattatctcatatgcttattatatttgacaagttgctgagagagaggaagagaggaatacatgcagtttgaaaccacatggaggccaggtgtggtggctcacgcctgtaatcccagcattttgggaggctgaggcgggtggattgcttgaggtcaggagttcgagactggcctggccaacacggcaaaaccctgtctctactaaaaatagaaaaattagccaggcgtggtggcacacacctttaatcacagctacttgggaggctgaggcatgagaatcgcttgaacctgggaggtggaggttgcagtgagccgagattacaccactgcacgcaggcctggatggaagagtgagactcagataaactgctaaacataatcctaacaaacttggattctttactttcaaaatcagcctgtctactccatcatgtcatctcattgatgtctacatactttcgtcatctccttcttgaagttttaacccagcagtggaaaagatgcaactaaactctcctttttctgtaaatcagtctttagcatgaatttggactttctgcttccagtgtatgagtgtgtgtgtgtgtgtgtgtgtgtgtgtgtgtgtgtgcatgtgtgtatgtgcatgtgtgtatatgtagctagctaagttaaaatgtatatttttaaattatgagctattcagtcaggcaaatgatatagcaaatactgtcatgaccacccatgtaccactgctcagcttaaaaaataaaaaattaggctgggtgcggtagcttgcacctgtaatcctggcactttgggaggccgaggcagacggatcattttgagctctgagacaacatagcaaaacctcatctctacaaaaagtacaaaatgagccaggtgtggtggctcttgcctgtggtcccagctacttgggaggctgaggctggaagatcgcttgagccgggaagcagaggtagcagtgagccaagatcatgccactgcactccagcctgggcgatagagcaagaagctatctcaaaaaacaaacaaataaacaaaaataaataaataaataaataataaataaaacattaccacaagatgagagaccacttcccgctgtccagtgtctggttataattttcttgtgatttggttaaccaaaaattttaacctattttatactattctgtagtatctcaatctaattttcactttatttcaagatttgaaaagttgtttactaatcatgatagatcttctctctcatcaggttagtttttgtgcatctttgctccccctgcaccacacacacttctgattatttttgtttctgatgattaaaaaaatacattagctcatttgatctttttaacgaaccagaagtaatatattgacatttctcagcctgtgcctacgatggcactgtgatggtgtctatgaccatatgtaaagtaagctcctcaggttttttttttttttaaacagctttattgaggtacgactgacaagtaaaattgtgtaaagttaaggtgatgatttgatatacttattcaagggttctgccaaagaaaatcctcaagcctacgagcactgtttggctggtggctgagaagcagtaggaatatgaatactgggatgcagtgaggacgttttgaattcaattgattttgaattaccatgtaccatcttagttttatctctctgacctgggacgtacccagccagctggcaaacttttctaatgaaactttgaattgttttggagcaggttacgtctgatacgaccaagcacttcagcgaaggagctataaggaggagaaatcaggaaaggctaaaattacaagaactagaagaagaaaggaaaaaagaaaagaaaagagaagaggaagtagctgaaaggtgtgtggaccaactttaacaaagattttttttctttgatttatggattaatccttttggatgaacagccagacttggtagataacattgagatggggggcaagaattggagcagattggaaaacgccactgaaagctacagtctttcagctgtgctgttacaaaaccaaaatggcaaaactgttgaaaacaagagacttcaaaaaaaaatatgtttgtcagggaggacaaataatgaggaatgatggaactagctagattaagatgtctggaaagaaatgatttttttaaaaagggacaagaaacttttatagtgaaaatcctagcctgccaagttaagaattttaccagtttaccaaatattatcaaaattacctagcctactaatttaaaatttttaagaatttagtgctgggatggaatttcttcttaaaatgttcaataaccaagctaacttgtatgcaagaaggcatggattgattgggagtatttttctcgttcgccatgttggccaggctggtctcgaactcctgacctcaggtgatctgcccactgtggcctcccaaaatactgggattacaggtgtgagccaccgcactcggcctctttgtatttatttctttgagcttatcgttgacgtccagttcaggagtttgagtctagaaggggctattggattgccaaaggttgccagtcgagtacagttgagccaaaactacagagctttgaaaattaattttacttcctggcccttcctcatgcatgtttattcttttattctttcatataaattgtagccattcagaaaaggagataagcaggctcacgcctgtaatcccagcactttgggaggctgaggtgggaggatcacttgaggccaggagttcaagaccagcctgggcaacacggggaaaccctgtctctacaaaaattaaaaaaaaaaaaattagccaggcgtggtggcacacgcctgtagtcccagctactcgagagggtgaggcgggagaatcacttaagcccaggagtctgaggctacagtgagctatgatcgtgccactgcactctaacctgggtgacagagcaagactctgtctcaaaaaaaaaggagataaagaatacccttccatgtgtcccttacttttttggctagtggagtgataggaattacttgaggtcatgtctgtgaaacttggccagagcttgagcctagtaaatataactagtcccccccaaatccaggctaaacatccaatttagataatcctctgagttttggctaagttctgacttaggtaattgtcccttctttccctttccccacgttcccataagggcctaaccaagacagttttaattttcagaaaacagcagaaaaaaagcccatattcttctaagccagtatgtttttctgatagtgtgctgtgttaagtaatatgtaccaaggaccagttcttaccctgaagattttctgagtattttgactcacctttgtctgtttgaaaccaactcataggttttattcacaagaaaaatgaaatagtctccatgaaagctggattctgtgatccctgcttgtggtttgagaatgtgggggctaaaggcccctcctttgaattctgtagccttctttatttgatactctatctctgcagaaggcctcctttacagcttctatttgactaagaaaatgatgtgtctttccccttgactggtgcttaacagtgttttgttttgttttgtttttttattataattgtctatgttaggcactggggttaacagtggtggattcctggaagctgagatgatctgttcttccttggcagtgggagggagggaggaaatcaaatgcctaataaataccttctgagtggtttaatcttaatcattgtccagaaaaagaaaagatgatgagcaaaaagtccgagtaaagaggaagaaggccagggtaaggagacaagccctgaaggaaagagacagacaccggcacaggaaacagaagcccaaagccaaagctgaggcacctcaagagccagactcttcagaggagtgggaggagaggaagtacctagtggctcagaggtgagttgaggcacttcggttcctaagggtactcctgaggaaaatttcaggaaggctattgccgaattgttcttcaagtttggtaggtactcacctttctgagacattacctttgcatttgagcagtggcctattgaaaattcactccatggaagactcattgcatccactggggcttattttaaataggctgacctctaacaatccgatagatttacaaaagggatatccacattctctaaaggagttgcgtcccaaccttccatttgactctctctctctttctctctctcattctctctctctttgtgtctctaaacttcaggacagtattacccagagcatttagctaatgcttctacttttctaagttcctaatggatgtaacagaaaaatgccagagggaagaaacggatggggggtgggtgtcaggtgttattaactttacttttccactcatctgcagtaggtttggtagagtcttgagccttgtaacaagctcgtgataatctagtcttaaactatttgataagaaatttctcacctcacagagcaattgttatgtttggagagtttcatttttggaaggtgtttctcccccttcctgacctcctaaagatagccagattctgcagatgtcctggattaaaagccagaaaagctaccaaagtgttcatttaaaaatccatattcagtgttttaaaatatgaatagtaaatgccattaggattacacagagttacttttatgtatatttgcaatcttgacctctttctcattagtgtggacaatcaaacttagtgaaattaggatcagaaaaatgtcacatttttattgataataaggctagctggatctcttttcattttccttaatgacctctgagggtgactcctaaagaatctatctttttcaatgtgtgtggtgtctgattcttggcctcgtaaatactaatacccattatgcagtcccaggttctaatcccaggtagtgtgtaggcactgtgctctgatgtgtgtcaggtgtcagtgagagcacagtacaaagcctccagcagggtggggcctgtgggcagcacctttcacctgctgtgcagttatggagagcagatagcactgcagacatgattgcagatagaaccacgatcacggccacatttgctacttgctaccttgcttcttactgagcacaggggaatggggaggaaactcggagacagccttacctgcagtccacagtaagaggctggtatgaaaagaaagacagtttatcttttaagctagtggacccttttagatatacgattcacctgtcagtcttttcttgtactgggatttttctgggagggctatagataatttcttattcctctttgtatctccagctcctagcacaatacctggaacatcaggcttattgattttcaaacaagtgaaaaaagagtcatgtgctttgaaggctatgtaaagtgtggtgccttctcacataagcatgggcatagacctactcaaaacagttcatattagactaagacatttaattttgccttctatttcctcagtgcaatattgttcctaatttggatctatcccaggtattggaagtctcttcagaacaatgtcagaaagcacaatttttctttggaattttttaatctgtttagtttttcatgagagatttttaatctttttctttgaagggatccatacagtttaacccacaggaagtcgacattattggcaccaaagctaatgattctccagggaacacattgaaaactctggaagaacagctaaacactctgtaccttcaaaatcaagaggaaatgtcaaaatgtcaggttgccaagtcagacaataaacaaaaacaaaaaatgaagaaaacaactagggatcacttacagaaatcttcccactgccttggggaagaaaatttaaggtattcccctagaaaacagagagctggaatattattagatgatgaggaatatgaatacagtttgttttttaagcataactccttggagattacgataattgaaggccagtctcttgaaaatgaagaccaccacggttctagtgaatcctgttccagattatctgggagaggccaaggcaggaaacctaagatccatgaaacagatgcattttttgactatcttttcaattattatgaacctccacaatatactcgtatctgcctagaaacaagtcaggtagcaggcacatgtcagtggcagagggatgtccaagctaagggagatggatttcagattaatttgagaaagtgtaggcatcactcaatcaattcgagccaagtagaaaacctggaaaggaaagaacaggttcaagaaaataattactcatcaaagatttgtactcaggatcctgagcgtaaacgaggaaaagtagattatgccaaagaatgtactaatgggtttgaaactcattgccaggagacagcccataaagctggtggtcagctgtccccaactgatggaaacagctgtctgttggaaaagactcatagttatcatattgaagattccaaatccacaaggaaaagccaagtgtccccaccccatgagtcaataggcttaggtttacagttgacagatttcttagaggaaattagtagtgattctgaatgcttcagtgaaacccttagtataaacaaagaggagaaagagaaatctgtggccacatttaatagtttctcagaaaaagaacctcttgacactgacaaaatgatcactcgcaaacaaaatacaaggtcgagtcagcagacctttttttcaaagtggaagcgtgatggtgaggaaaaatactctaattacaagtttaggacaccaggtaggaagtctgagtatgaaccgagatggatatgttcatggcctaggggtgaaagtcatttcattagacatgaaaacaacaatggacaaatgaagggacaactagcccccagatacttgtttgatgaaggctactaccaggaacccagttccagttatctaaagaggtttagtgatagtacattggaccagaaagtgaactatgggccctctcaggtgcccgtaatgtcatcaagaagtgctaggtctttctattttggtaattttcacggaagaagagggactccttggaagtcagaatataaccagaattcaagatttagaggatgtaattataactatttgaagttcaattctgattattactataatagacataatggtcaggagtatattgactatggaagctattcaggaaataactgcactggttctttaaattttaaatgttttgatgaccacttagatcaggagtatcctttttcacaataaacatgttacaagaagaaaatttaaaaccaaatgtagccatgtaattaacaactacacaggaagacagcagcattaaaaacttcagaacctgtgtgttttatatttcccaaagcttgtcaatacacctggagtcattttgacctatgctttcaactttggcaagagaaataataatttgtatttgaccctgctcaagcttttaaatgctgcttgatccaaggatagacatttctatggttcagctaaaactttacttctacgccagtgaaggagcagattaacattgagaggggttgagatggccctctatggctccttaggtgtcataacatcatcatttagtgtcatttatctccaaagacgacagcagtgaatgaataatgatccttttacatgttctttgatttggtcagaaacaccacgtgcagcaacaaactttcctgacttttatttagaaataattgtagataaaagagacgacagttagaacatagacttcttcatgacattaaagagttgcatgagcacccaccaggagaaaattaatcttattactatgtttaaatactcaaagagttgtctttttcaagacaaagtcttggaagaagaatctaaaagtggtccagattgtcctttgaggtttaaatggatagtatttaaacccattagcagagttgttgttttttttttaagaaccccatgtctttccattttagaaaaacagcaagattgaagtaatataaccactggaatttgcaaaaggaaatattgaaaaattgtggggcaccaatgatgtcacttgaaaaaagatgctgtgactattccacttcaggttatgtaaccctttcactcagggctggattacatcagtttgtaaagtcactgaatatcccccaaactgaactttattaaacagtaacaagtgcctctcttctcaatcctcagtgatgccatcaagttttcaaaaagagtaaagagaaaagcctatagttttgtagctagggaaaaatgtatatgtgtaggatttgtaaactctcaacataagcaattgatctttttacctactagtttttgacttcataaatgtttttaaattgaaatattttatggattcttaaagacttacatcttagtgcagtgcatgttttatagaaagctccgctgattcattctgccttaccttgcatttaggacctcaggggcaatcgattaccttttttttctccaacaaaactatgcctgacctggtaattgaagacattaatgagattagagactgtcagcaacaggaaaaagtcatttttaatccacagaagcagtaaagggcaacactttgatgtgacatgattcattcaaacactcttaatttgacattctgtagaaaagtaccagctgatagagccaggtagaatgccagtcattgtggttgcccagaatatcacaatgtgtgcatataaccagccttttgagcaaacgggtatgtgaaagggctacaaaagcttatttatctgaaggaagagccacaagttgtttcatcgatctcttctaatcatagagctatgttagtacatgcaagaagtcagaaatgaatgtaccatagcagatgatgtttattattaataagataataaccagtggatgatttgttggctcccttgtgttcaattccactttcaagccagtgactcttccatcaaaactagatttggcttgtcaaatctgaaaaacattgcttatggggcaagtgccttgaatgttaatgttcaaagtactgttgtccagagtagccttttgaactgctaacagcttgtattttgtcaggcaactttcagtaaccaggtattatttttctttgacgaaaacctgcctcttaatttttcatgtgtcatgccattaaaacaaagaatattatgagtttgtaatgagaagcagctatgcttttgaaaaaaatctcactgtgttctgtcacttgatttttctttgcagagtttttagacatgaaaacagtttgctgctcagtagtcagacataaaaataaattgcagaatacagcatgtgcaatttttatgtgtaatagaaccggtgctatttctatataacatttttgtcttttttttttttttttttttgctaaataccatcctgggacttagaagaaagtaaaaatactggttttatgtttacattttgtataaccctagacttgtatatgtcttataaagagtcaacctttttggtgggtaggccctaaatgaggaagataacttatcctgtactttttaattgaatggcttagtaaggagtaaaatacaactaaaatattgtaaccaccttcttaattaacactgctattgtttgttgtgctaagtggtgcaaaagtgttttctcatatctttttctatgtcctattaagggcctgagctttaaactttgtcttaaggtattttcatgtttttcttatgagttgttggtagttatgcaaaaaaactaaaaatatgtcaatgtgctttcaatttgtttaaatttctcaggtagaaagccatgtaacctggtaattttgaaaataagaatcaaataaacttatttttacttgttgcaaaattgtttaaaatagtcatttttaaataaatgctgataagtccac

SEQ ID NO: 1211 - DNA, 27012 bp, mus musculus
agggcggcagagctctgagggcagcccgcgcgcgggcagacgaacccgcagtcgcgagctactaggcagccgcggtgagctcgccagagcctcaggggatcgaggaggtcacggggcgttggcaccgggtcgcgcgccagcgttgccctcttagcgaggacgcttctgcgcgcggtgagctcgacgcgagccattcaacagctggcctcgcgagcgacagtcgcacggggtgactgggaccgctgacggttgcgactgcggcggttagagggaggcgacgacggcggcatagacgttggcggcagcggcagggacggcggcggcagtcccgttatcctaccggatcctggagtagagacgaacggttcctgaagctcccggtaaatgccctcggctctgtcctcagaggaggcagccacgctgggccttcggtagggactggggaggggctgcgcaagagacccgagttccccgcttgccccagcagagtcacgttttccagagtaacgcctaggctcttccaggtccactctcccctcactcgagaccccgctgagccagggagcgcaccggaacccactcgagggctcacccaggccgctgttgggcgaaggtcgaggcattcccctgaggcacgttggcagtgacatcccgctaatgggaactgaaggtgccctctcctgctcgaccggtacgccaagtgcccatcattagcagggctctgccgctgccgccccctgatgaccctcgtccttggctttagggacttctcaagagattctgagtctcggcttgaggtttccggcggggtggattaagaccgttttaatctgactgtggcttgctcacccacaacgctttcgggatgcaagatcctgagcttgggttggtgggccgagaggcgaggggaagaatcaagttggggaggcccatgctgtaggatatgcatgccatacccgcactcaggggaaatcatagtcgtggtccttgggacccgtgccgccttttggtctcctgctttttgtgtttttatttaaagtcgaccattacaggaggcagaactttctagtgctgctaactccgaggggtaacaaacgtgtattggaacgctgggttccagtatgggaaactggttaccctttgggcctcttcttggtgtcttttctagattgagaatatgatctcaaagatcatgcccatttcgccctgttttccggcctatgtctgatctaaccttggaacttcatgctgttgagagtgtaaacttgtgcagtgcaatcggtagggctcgttcttcatgctaagaaaaccattttttggaaaaatatgttgggacctctcaaattctggttttttgtttgtttgccttttgaagcatgtgacattccagcagttacatttttctgtgctctggttttttgggaggaggggagagaggcggggggaggggagagaggctgggggaggccttcaaagaatggagtaacttgaagcatggagtaacttccatgaagggatttttccttcaacccttgtggagcacagaggaaagtgactagtggaataggcctgctggcaaaggtgcccggaggatcccagctgccacacacatcaggatggatggggctgacttgaggtggagtaacattgggcaggagggggacagggcctgcagagtccaccttggcttttgtagtggctttccattttgttccagccaaagagtatacctgcagtgcagcctgtttgtccaagttcccatcatacacttacgtgaagagagtggcctttgctggctttatgtgtcatctctacccacagtaagaaaggcgaggtacagaggttagagaacatggagatgataatggtggtggtggtggtggtggtggtggtggtggtgatgcgtgtgtgagagagagacttattccaaacagtgaagcagtttatcttcccagcatgcattcctacctttgctagagagagagagacttttgctgagttatttcagagccagggcgctggtagttgtccaactctctgattcagtgtacacttgggtctgtgggttctatgttgtatccaacatgcttctggcactttaagaagctataaaaccaagctgtgggctgaggcaggctaatgcctggggcacagagcaaatgtggacatcatggaatctagttgccctttgctcagaagagacagcgcaagggctggagcacttgcagaagaagaggaaggtcagtgaaaatttggtagtcataataataatgaaaatttactgaacacttactggaagttaagtactttacttggatcattttaattaatttatttattttgagacagagtttcactcttgttacccaggctggagtgcagtgcatgatctcggcttactgcagcctccatctcctgggttcaaatgattctcctgcctcagcctcccgagtagctgggattaaaggtgcacgccactacaccctgctaatttttgtgttgttggtagagatggggtttcaccatgttggccagggtggtctcgaactcctgacctcaaatgattcacctgcctcagcctcccaaagtgctgggattacaggcgtgagccactgcacctggccacatcattttatttaatcccacctgtaaggtaggcactattatcatcttctgaagctcaaagaggttaggtagcatgcccaaggatgtcaccaagctggtcagtggcagaggcgggatttgaacccagatctgcttgacaccagacctggagctcaaaagcattttggtttttactgtcacagagaaggttgcataaaagaggtgaaatggagcaaggttttgaagggtgagtaggctttagatgaggagatgggatatttggctgaggggatcaacatctttaaaggaactcaaggaagactggcccaactagaatgggggatggacacacgggtgtggtgaaaatagggctggcaaggtgggtaggatcatgttttggagacctttgaagggaaactgttacctgaagcagtaagaagtgggggatgttgagaattttggggcaaggaagagcatggcaaaggcagtatcagtcacctggtgtgaccagcatgtgcctctctcatcctcattctcatttctcattcttgagaaccttacccaatggtagcacatttagacattgtttttggatttcctgaacccctacagagtagcagacatgtgcaaccaaatacattcctgggtccagtgtgcagaaggaacacgctaggggccctgggtcaaactcagccttagatgagtgtgctgcggcctgcacaggatttgaaaaagcaattgaattagtggtcaatgttgaaaaagcaaaagaactcagtaaggatcaggatttccagcttatcttgaaatgctggaaggtctggtctgcatttcacttgtggagggcaaagctgtgcagaactgacttctttagcaaggggcaggtgctctgctttcccatggtcctacccagtccccagcccccgtgcttagtacctgcctaatcctgtaggccctgggccactgctcaagggaaacaagcccccacttgggaagtttcacactcaggattagcttcttgtcttattgtgtaattaggaaattgtcagacatgcagtgaaactgtctctgtgaagggtgaataatcttaacacacaggaatgctgtgtacctcattgtggagcattatccatagatagtagctttctttgggcctggggctgaaagcccgctgtgctagggccccaaagagacattctggtgggccttgctgttcttcatcctttgcttgcactcaggttttctgtttgctgaatagttgatgtgtataggatctgggtcaaaaagatttaaaaaaaattgcgggggggggaaaaaaccccgaagtgactacctaaaagatagcatgttaaaaatattaatctggagtcccagaaagtggtccatacgttttagatgggcaggtataagccactctgtgttggcatttgaggtgcggagttctttgttgtgcaggtctgtttaggaacttcagggcagttagcatcgctggccccttgcttacaaaatggcagtggtgtcctccctatgctagttattgtgacagctacaactatttttatgcatgtcccaacactcttgaagggagcaatactgacacacttaaacatgactgtagcctattctcaggaattttaacactcatgtgaaagaatgttaaaaccattattgcttgtctgtagcccaaagtaccaaatgtctctcctgacattcaccattttcttccttagattccagttaattgtctcaatttctttccctttctagactcagttgtttgagggtgactcttcactgtggtccccaaactgtcttaaaggtgcttggtaggtacacttaaattaatctcaatgttcactgattaatgttaataggtctaggagtccaaaagaacaagcaagtctgcattatcatttcactgtgggtctttaggtgctgttattagtattttaagtagggaagtaatacttttttttttttgagacagagtctcagtctgtcacccatgctggagtgcagtggtgcgatcttggctcactgcaacctctgcctcctgggttcaagtaattctcctgcctcagcctcctgagtagctggaattacaggcgtgcaccaccacgcccggctactttttgtatttttagtagagacggggtttcaccatgttggccaggctggtctcgaactcctgaccttgtgatccacccacctcggcctcccaaagtgctgggattacaggcatgagccactgtgcccagccggaagtaacatcttttaaatgtagttattgcacaaagtctctgttttacataagatttagcattattaagttcctactatatgttaggtactgttctaggctctaaagatataatggtgaaccagacagatgcagattaaaaataaaatgttaacaatgacacaggatgatcagatggtttctgtgttacagtgaaaataaaatggtatgataggctaccaagtcacaggggtgatagcagtgctatttcagagagtgtttagggcaggcttctctgaggaggtgacattcaagtcaaatgagagcaaagtgaaggagccagccatgagaaaatcttgaaggagaacccttcaggtagagggaaccacaagagcaaaggcctgaggagtgaacctgatgcatttgaggggcagtaaaaaggccagtggggtgagatggagagaacaagggtaatagggagaagggtaaaaagctgagttgaaagaggtgggcgggggccatgttttgaaggtaagtagtttggatttcattcaaaacatgatgagatgctgctggagggttttgaacagaggagtgacatgatctgatttaggtttttaaaaatatgacattggctgttgtgtagagtagactctgtaggggcaaggatggaagaagaaggaccagttaggaggctgttgcagtaatccaggtgagagatcacagtggcctggactggggggtagcagcgaagatggagatgaatttgggatttgtggtaaaggtggagtcaaaaagacttttggaaggattaactcctaggttttgagcctaagcgcctgggtgcagggtggctctacttagggagctgggaatcactgggaatcaggggagcaagtgtgatgtggaggacaggtttaggagatgcaaattaagggctctgatgcacttgttaggttgagatgccaatgatacattcaactggagacattgaataggcagttgaatatcaatataaaagttggctggaactacagcctacataaaattaaatgcaaattaaagctgctttaagttgtcattttatactaataaaggtaacagaaataaaaatgataatgatccagtgtgatcaggactgcaggggaatcaagtatgttaataatgctgatggcctaataaattggcttttaaaaaatatttacataagacctggaacggtggttcacacctgtaatcccagcactttgggaggccaaggcgggcgaatcacttgaagtcaggagttcgagacaagcctggccaacatggcgaaacctcatctccaccaaaaaaatacaaaaattacccgagcgtggtggcatgtgcctgtaatcccagctactctggagactgaggcatgagaatcacctgaacccgggaggcagaggctgcagtgagctgagatcatgcccctgcactccagcctgtgaaacagagtgagactctgtcacaaaataaataaataaataaataaataaataaataaataaataaataaatttacacaaagatttccatggtagcacttgttctcataatagtagtgtagagtagtggcagtactcttttggaaagagttatgctctttcaaaaataattgaagacacaaatccccagggagaatatccaactaaatatatagtaagtatagagtttctatagaatttttctctatatagaatttcttttttaacaacatttaatttttattgacacattgtaattgtacagaatttcgagagaaactctctataggcatgaaaaatgaggaattgtgttgaccatatcaatatctggaattgctaataaaacaggtgcaaaaatcagatcatgatggtatatacaatggtgtaaatcttacatgctgttcatgctgaatattgttaatatacagttgtcttaattttaaaataatttcattcgcttttgactttgtacctttttctctctggcactattccctggttaggatgccataacttcattttggtccactgtgaagagttcaagtgaattgtggcttctccagtctttcttcccttgatcacattttcagcacgaggtattggataatatcctattctgtgggacttgtattcaaataagtttaccttgggatttttaaaaggttgggaagtactgttactctcaaaaactgtgtaatagtgcaaagcagggtcccgtgtgaaggttgcttttgacctgtaggtggcgactggtgggcaggaattttgctggtaattttcagattgtggaaatacaactgagaagcaaaacactggcaacctcatgatacgcatttcccacaaataatactgattattcaatgatggaggcaaaagtatggaagatactcagccacattcctttaattccctgatagctttttttttttttcatgagaagagaaagcagtgagtcttcttcagtagcattgtttattaatccaaggtataaagcagcattcctggctggaggtgtctggagagaggtgttcttcaataaaaatgttcctggtgcagaagaaggggcaaaagaccaaaggactggtcagataggtctgctgactgctctgtgcaggtttttaaaaatagcttcttcccttgttatcttggaatgactcctatacacactagcttagagttagttatgtgaatgcatttgcacagaaaggccaacacaagacttttcttcaggctaatttattttctattagcctcagaaacactcagaacactttgcttccacaaacattaccacatacggaaactttaggatgatgttttaacacaaggaaaagaaaacaggaaattaagttgctcagagttaaattaatgtgaatccagctttcttcatctcaggatcaaaattccacatactaaattctaccttcgagctgattttctttgaatggtggtagaagagattctctctcagtaggactctaatatttcattgttgcaaatttatcattgccaaatggctgtgcatctccaaaaatcccttccattctgcccagaaagcccccagtgcccccataagcccagaccattttaattttggaattcggtcatttgtcgggccatatattggctatattcttattattgcaaaactgagtgccactcattttaatgatgtgatttttaaattattcaagatcagagcatatggtcagcctcagttttaaaatgttgttgggctaatggcgtgtcagaatacttgaacgtccatgcgtggcatcttgactgaagaaccatggaatgtttttatttggtcaagatatactgggattctgtagtagccagaaaattgaaaattggctaggttaatttgacccaaataaattctggcttccctgctatttccataaatatgttgtataattgcatacatcttaaatgttttcaaaatgactaaccttaaaattcaaaagcctggagaaaaaagaaaggcagcaaagagctactttgaaagaggatattgattgcatagatggtcctattttttccactttttttttaagtacctcattcaaatggcctttctaatactatgacagcaaatatttatgagagtgagaacaagcaagagagaatgaataggtggctactttgctgattactcaagtgcttttaaagtttcaagttatatttctgatctaaaaatcctgagatatattaggtgaatctctccagtatctcctgaaacaggagaagatattggaatgtcttaggatgcagactgtgcagaatttactgaggtttcactgctggttaaaataaacattttaggcttgtgacaacatctccagtctatttccttttctctattcccttatcctactgttattcaatcaactttgctacgagatatagaggcaaggaagatgaggtgaccgtgttctctgagaatctcctagaaatgttttggcattgggaacatgttgagtgaaatgttttagtgaagctacgtacacaagatactgctagaatgcacactgtgtaaacattattaaataactataattttttaaggttagaggagctcccattttcctatgcaaagatattaaagaataagtcatctcagtagtgttgcttttaatcataaggctaaaggaaagatatgtgcatgtgggtggggaggattggggaggttatggtgaacacaatagaatatgggaatactagaaatatttattaaaatttgactttttgataatttgtgaaggtcatgattatggcatttcttgccattaaggcttggtttatctaggctcctgaaactttgtttaataaattaatctatgcatataatagtgattggtgaaaatgatgggaaagttattaatgaattctaccattacggtcaattgaagcacaggctaattaaaagggaaattagagacaaattaagttgttctaaagagtcagttttaagtcaaagcctaataatttgatcttagtgattccacacattttggtatgtatattttgatgaatatataaatatgcataaaatacataactatatctacagtataataactaagcatagattatgtttttgtgtatttggcttaaacagggttaaaaacaaggattgtgtaggggagaaaatgacaatcctttttttttttttgagacagagtctcgctctgactcccaagctggagtgcagtggcacaatctcggctcactgaaacctccgcctcccaggttcaagtgattctcctgcctcagcctcccgagtagctggcattacaggcgcccgccaccacgcccagctaatttttgtatttttagtagagacggggtttcaccacgttggccaggctgatctcaaactcctgacctcaggtgatccatctgcctcagcctcccaaagtgccaggattacaggcgtgagccaccatgcctggactagttgagtattttccaaaaacatctgtttgcttttgctgtgttataaattatcatttatgagttaaacgctgcagctaagccaggagtggtggttcacgcctgtaattccagcactttgggaagctgaggagagagaggtgagaggattgcttcaacccaggagtttgagaccagcctcagcaacatagggagacccatctctacaaaaaataaaaaattagctagacgtggtggcacgtgcctgtagttccagctactcagaaggctgaggtgggaggatggcttaacgcccaggaagtcgaggctgcagtgagccttgattgcacaactacagtctagcctgggggacagaacaaacccctgtctcaaaacaaaatattttgcagctagatcagtgattgatgagggtagggaggaaatgtggagggacaatgggtattttgactaccttgattgcagtgatagtttcataggtgtgtatacatatgtcaaaatttatcaaaacatacagttttgatacatgtgtagtttatgttatgaaatctgtagtttattatatattaattttgcctcaataaagcagttctaaaagataggttctgcagcccattgtgtagctagtattgcaattgccaagtgagcctgtgatattcaaagtcctgttctgatctcccaggcttccatcgtgactcacacaaactttgactatgggttcaaatgcctataggcatttacagagatggcagacagaggggtgcttttggtgggtgaagggagttgctattgtattaatctgttttttttacccttttctggacaagttggtgtcagcggttataaattgcttccttttagtagcttgttattatcatctgaagttcctctttttagttaaacaaagtacaaaattaatacattcttattgtaaacattaaaaaactgaagcattaagaaatgtacaacatgggcatatagagtaaaataatagattggagactccaaaagctgggagggtgggagggaggtgaggattgaaaaattacccactgggtacaatgtacactattcaggtgatgggtgcactaaaagcccagatttcaccactgcacaatacatgcatgtaagaaattgcacttgtactctctaaatatataaaaataaatttttaaaaaggaaatgtacaaagtatttaataaaaagggaaagtttattcttctcctatagtcccaatccattttctaggggaaatattgttaacaatttgatgtatattcttccagacattatatattatgtctgtgtgcatggccatgtgtgtttatattacttttataagagcaatatcatatgttactttattattctgtcacttgctttttattttttccctaaaaactatcacaggcatccttttttgtcagtaaatacagatccactgtctggctccctacctccctccctacctccaaaaggtggaagggtgggagggaggtgaggattgaaaaattaccctttgggtacaatgtgcactattcaggtgatgggtgcactaaaagcccagatttcaccactgcacaatatatgcatgtaagaaatctgcacttgtactcactaaatatccaaaaataaaattactccctccctctgttcccttccttctcctcctcctcttcctcctccttcttctcctatatattttattagcttttgacttgaggtctccttaaggaagaagcatcacaatgggagttggttgttgtgcacctatgtaccagtcactatgctagttaatttttaatgacttagaagaagttgccaatgacacttctatagcaatgaagccatgccgtatataaaaagcttacttcttggtcatactaggtcctcaatattttttaaaagtaagattagagaattagccctctattttgggagagtaatttaagatgaaatatttattgacattcaattttaagatctaaagcctgtgaaccactatgaaagatatgagaagaacaaatgcctcagtttcttgtcatttttgtccttgggaaacaggaatttaagttgtgaggattttaaaggaggtcagttttttgtttttttttttttcaaaaacaattgggtcttcttgggaaaatcagtttgttcttatagtcatccattttatccaacattcttgattatacataatttgtgataatttctaaatatcaaatccatgataaaggaatttagaaattggcctccatgaagctacttaaaataatgtaacccaggctttgaaatcaatccaagagaagcattctacagtgttttaaacaaaggcagtattgctggagcaagtggagagcttgacaaacctgattactttgaagagagtaattctgttttgggtgaatattttctggaatttttttaaaaaaactattgctttatattaggttgtataaataaatacctaatggttataaataaattttagagttcagtatatcttaattgaatatcacattaatttttctcctagagggggcttagtgttgactcttattgcaaattgcagcaaactaactggattttttccattttgctacatagataatgcttttggagaaagaaaacatgtttcttctcatatcatcccatttcagtgttgctgtcataagggtttctagaacatagtatcttagatactgcttttgatgaccttttataaaatcagtctctacaaaccttgccttctaaaggaagttaacttggattgtcctttaagggtagttattaaataattctgtacctataaagttagccaagatttcgcagtaaattttgtgttagaatttctgtcatctggccatatatgtttggctctaaatttccctaaagttgacgttaatgagaaattctggtgacatagagtctgaatatatctgctcagaaaaaaactcctttattaggaagtgctatttaaagtaagcaaatagaagcttaaatctctaattcccagcattagtgatcttgttcaccttagtactgcttcaaagagtttgttaatatgaagtaaacaggaagcactcatgttttggggtttttccagtccccaagtagagggcaaattcactttgtcactcattagaaaaggctgtctcttcttaactttaacttagagatcaatttagttaaagtcaacagactggaggaacaagagtagatatgtccattttagacttggaaaccaacgtggacaagggatgctaagtcaggtgcatgggttagaactataagttctatgtatgttcggtgcatgttcattaatgtgccacccttgccctgtttgtgtaccatccccagcagatttttaatggaactttacatttaagatcaattgtacaatagattagagatttagaaaatcttggcttctcaatgtatgggcaagtcatttaattttcctgaaactgtctgaatttccccatctgtaaaacaggcaggcaaatacctactcacgggttgcttcataaatcaaatgagataaagtaagactactaccactaatagataatattataacttatgtttattgagaacttcctgtgtgccaggcacattctaaggatttcacctgtacacactcatttaattctcccccaaatcttattatctctattttatggttaaggaaactgagacacagtatatactctttgaaaactctaaaaaacattaaatattattaagtaaatattacatattattattattattcccttatagaacagatattattatttttaataggctttattttttagagaagttttaggttcacaagaaaattgagcataagggacctggcgtggtggctcacgcctgtaatcccagcactttgggaggctgaggtgggtagatcacctgaggtcaggagtttgagaccagcctggccaacatggtgaaaccctgtctctactaaaaacacaaaattagccggccgtggtggtgcacacctgtaatccaagctactcaggaggctgaggcaggagaatcactggaacctgggaggcggaggttgcagtgagctaagatcacgccactgcactccagcctaggcgacagagcgagactccctctcagaacaaaaaaaaaaaaaaaaaaaaaaaaagaaaaaagaaaaaaattgagcagaaggtagagaggtcccatatactcctgctcctacacatgcccagctttccccatgattaacgtctcccaccagagtggttataggtgtgacaatcagtgaacctacattgacacattatcataacccaaagtccatagtttacattagggttcaatcttggtgttgaacattctgtggttttggacaaatgtataatgacatgtatccatcattacagtatcatgcagcatagctccaactgccctaaaaatcctctgtgctcagcctattcatccttccctcccctctagttcatggcagccactgatctttttactgtttccatagttttgtcttttccaaaatgttatataataggaatcatatagtatgtcaccttttcagattggcttctttcacttaggaatatgcacttaagtttcttccacgtattttcatggcttgatagcttatttctttttggggctgaataataatccattgtctggatgtaccacagtttatttatccattcacctactgaagaacatcttggttccttccaggttttgacaattatgaataaagctgctataaacattatatgcaagtttttgtttggacataaattttcagttcctttggagaaataacaaggagtgcgcatcgctagatcatatggcaaaagtatgtttagttttgtgagaaactgccaaattgtcttctgtaatgactgtaccattttgcattcccaccagcaatgaatgagagtttctgttgtaccacatgctcattgtgatgcttcttccttaaggagacctcatttggtgtggtcagggttctggattttggccattctaataggtgtgtggtggtatctcactgttgttttaatttgcattttcctgatgacgtatgatgtgaagcatcttttcatatgcctttttgctatctgatatttcttctttggggaaggtgtctgttagggctttggcccatttttaaatcagactgtactcttattgttgagctttaagagttctttgtatattttggataaccgttctttatctgacatatcttttgcaaatattttctgccggtctgtggcttatctttttattctcttgacagtgtgttttgcagagaagaaattttaaattttaatgaaatccagcttatcaattatttcttttctagaatgtgcctttggtgttacatctaaaaagtcattgcaatacgcaaggtcttgtggatgtttaaatgttccagcaccattttttgaaaaggctatctttgctctgttaaattgtctttgctcctcttttttaaagatcagttgactgtatttatgtgggcctatctgggctttttattctgttctattgatgtatacgtcttttcttttaccaaaccattatcttgattactatagctttatagtaagtcttgattttggatagtgtcagttctccaactttgttcttcttcaatattgagttagctattctggatcttttgcctctccatataaactttagaatcagtttgccaatatctacaaaataactcactgggattttgattgggattgcattgaatctattgatcaagttggcaagaactgacatcttgagtcttcttattcgtggaccacatatttagtttttcttttccttgtatagatcttgtacatattttgttagatttctaactaagtatctcattgttttgtgtgctaatgtaaatggtattgagttttaaatttcaagttctacttgttcgttgctgctatataggaaggctattgtcttttttgtattaaccttatattctgaagccctgctgaaataacttattagttccgggaatcagaagatattattttaattctgcttgtagtatagctttccttatcaatttgttctaagtccagcaatgccagcaccatttcacaatccaaatctgtgtattactccatctgtatcaaaattttctctttcgttctctaaggtggtctgaggacaacatgacagtcacagtggtgtatgataactctgaggcaacagagctctgtgcagctcagcacctctacctcaagcccatagcaaaattgttgatcaacatattgcttccagggagtctagaacctgtaaggcccttctctaactgggaagttcttgaccagctgaagagcctgatttgccctgaccagttcaccacagttcagctctccaagagtacaaaggacttcattcaattggagggtgaggctgaaacccgaagtttggttcagatcctgaaggcaaagttacatgggaagattatcaagctaaatggtttgaaaaaacacttaaaagtagtggctacagatgcccagggagaatgggagcacttccccaaggaaaaagagccctcgttgagtgatggggctgaagagcaggagaagagcccagattccatatgttttgaagagttgccctgtaaatggtttgcacctaaatgttctagcaaagagaagccatatgaagagatcctttgggtagtctttgaaagttttgggaagatcaagaatgtggatatccttatgcttggcccctacagagaagtgatgactgacaggagctttgggggttttagctttggcttacagacatttgaggcattcatacagtaacaagaggcaactgactttgtaaaagccatggagtccctttgaagaatgaaactgatgcttaaaggaaatgatgggaaagctctggcatgtaacattaaggtaagaagtagccagagtttcttttattttccactgttcaggtgatcctgaataaaagctggaaggaagcatctagaataaattttcttagaccctaccaggctctgatcaataactaatatataaagacttttattatttttaataaatggatgtttaggaagaaaaaaatcctgatttgaacactcattcttgtgctatcaggcatgctgccagctatgactttaaagtgatggttcttataatctgaggttctgtctcaactacttgagggcattaaagaattcttcatggcccctatggaattatctcatatgcttattatatttgacaagttgctgagagagaggaagagaggaatacatgcagtttgaaaccacatggaggccaggtgtggtggctcacgcctgtaatcccagcattttgggaggctgaggcgggtggattgcttgaggtcaggagttcgagactggcctggccaacacggcaaaaccctgtctctactaaaaatagaaaaattagccaggcgtggtggcacacacctttaatcacagctacttgggaggctgaggcatgagaatcgcttgaacctgggaggtggaggttgcagtgagccgagattacaccactgcacgcaggcctggatggaagagtgagactcagataaactgctaaacataatcctaacaaacttggattctttactttcaaaatcagcctgtctactccatcatgtcatctcattgatgtctacatactttcgtcatctccttcttgaagttttaacccagcagtggaaaagatgcaactaaactctcctttttctgtaaatcagtctttagcatgaatttggactttctgcttccagtgtatgagtgtgtgtgtgtgtgtgtgtgtgtgtgtgtgtgtgtgcatgtgtgtatgtgcatgtgtgtatatgtagctagctaagttaaaatgtatatttttaaattatgagctattcagtcaggcaaatgatatagcaaatactgtcatgaccacccatgtaccactgctcagcttaaaaaataaaaaattaggctgggtgcggtagcttgcacctgtaatcctggcactttgggaggccgaggcagacggatcattttgagctctgagacaacatagcaaaacctcatctctacaaaaagtacaaaatgagccaggtgtggtggctcttgcctgtggtcccagctacttgggaggctgaggctggaagatcgcttgagccgggaagcagaggtagcagtgagccaagatcatgccactgcactccagcctgggcgatagagcaagaagctatctcaaaaaacaaacaaataaacaaaaataaataaataaataaataataaataaaacattaccacaagatgagagaccacttcccgctgtccagtgtctggttataattttcttgtgatttggttaaccaaaaattttaacctattttatactattctgtagtatctcaatctaattttcactttatttcaagatttgaaaagttgtttactaatcatgatagatcttctctctcatcaggttagtttttgtgcatctttgctccccctgcaccacacacacttctgattatttttgtttctgatgattaaaaaaatacattagctcatttgatctttttaacgaaccagaagtaatatattgacatttctcagcctgtgcctacgatggcactgtgatggtgtctatgaccatatgtaaagtaagctcctcaggttttttttttttttaaacagctttattgaggtacgactgacaagtaaaattgtgtaaagttaaggtgatgatttgatatacttattcaagggttctgccaaagaaaatcctcaagcctacgagcactgtttggctggtggctgagaagcagtaggaatatgaatactgggatgcagtgaggacgttttgaattcaattgattttgaattaccatgtaccatcttagttttatctctctgacctgggacgtacccagccagctggcaaacttttctaatgaaactttgaattgttttggagcaggttacgtctgatacgaccaagcacttcagcgaaggagctataaggaggagaaatcaggaaaggctaaaattacaagaactagaagaagaaaggaaaaaagaaaagaaaagagaagaggaagtagctgaaaggtgtgtggaccaactttaacaaagattttttttctttgatttatggattaatccttttggatgaacagccagacttggtagataacattgagatggggggcaagaattggagcagattggaaaacgccactgaaagctacagtctttcagctgtgctgttacaaaaccaaaatggcaaaactgttgaaaacaagagacttcaaaaaaaaatatgtttgtcagggaggacaaataatgaggaatgatggaactagctagattaagatgtctggaaagaaatgatttttttaaaaagggacaagaaacttttatagtgaaaatcctagcctgccaagttaagaattttaccagtttaccaaatattatcaaaattacctagcctactaatttaaaatttttaagaatttagtgctgggatggaatttcttcttaaaatgttcaataaccaagctaacttgtatgcaagaaggcatggattgattgggagtatttttctcgttcgccatgttggccaggctggtctcgaactcctgacctcaggtgatctgcccactgtggcctcccaaaatactgggattacaggtgtgagccaccgcactcggcctctttgtatttatttctttgagcttatcgttgacgtccagttcaggagtttgagtctagaaggggctattggattgccaaaggttgccagtcgagtacagttgagccaaaactacagagctttgaaaattaattttacttcctggcccttcctcatgcatgtttattcttttattctttcatataaattgtagccattcagaaaaggagataagcaggctcacgcctgtaatcccagcactttgggaggctgaggtgggaggatcacttgaggccaggagttcaagaccagcctgggcaacacggggaaaccctgtctctacaaaaattaaaaaaaaaaaaattagccaggcgtggtggcacacgcctgtagtcccagctactcgagagggtgaggcgggagaatcacttaagcccaggagtctgaggctacagtgagctatgatcgtgccactgcactctaacctgggtgacagagcaagactctgtctcaaaaaaaaaggagataaagaatacccttccatgtgtcccttacttttttggctagtggagtgataggaattacttgaggtcatgtctgtgaaacttggccagagcttgagcctagtaaatataactagtcccccccaaatccaggctaaacatccaatttagataatcctctgagttttggctaagttctgacttaggtaattgtcccttctttccctttccccacgttcccataagggcctaaccaagacagttttaattttcagaaaacagcagaaaaaaagcccatattcttctaagccagtatgtttttctgatagtgtgctgtgttaagtaatatgtaccaaggaccagttcttaccctgaagattttctgagtattttgactcacctttgtctgtttgaaaccaactcataggttttattcacaagaaaaatgaaatagtctccatgaaagctggattctgtgatccctgcttgtggtttgagaatgtgggggctaaaggcccctcctttgaattctgtagccttctttatttgatactctatctctgcagaaggcctcctttacagcttctatttgactaagaaaatgatgtgtctttccccttgactggtgcttaacagtgttttgttttgttttgtttttttattataattgtctatgttaggcactggggttaacagtggtggattcctggaagctgagatgatctgttcttccttggcagtgggagggagggaggaaatcaaatgcctaataaataccttctgagtggtttaatcttaatcattgtccagaaaaagaaaagatgatgagcaaaaagtccgagtaaagaggaagaaggccagggtaaggagacaagccctgaaggaaagagacagacaccggcacaggaaacagaagcccaaagccaaagctgaggcacctcaagagccagactcttcagaggagtgggaggagaggaagtacctagtggctcagaggtgagttgaggcacttcggttcctaagggtactcctgaggaaaatttcaggaaggctattgccgaattgttcttcaagtttggtaggtactcacctttctgagacattacctttgcatttgagcagtggcctattgaaaattcactccatggaagactcattgcatccactggggcttattttaaataggctgacctctaacaatccgatagatttacaaaagggatatccacattctctaaaggagttgcgtcccaaccttccatttgactctctctctctttctctctctcattctctctctctttgtgtctctaaacttcaggacagtattacccagagcatttagctaatgcttctacttttctaagttcctaatggatgtaacagaaaaatgccagagggaagaaacggatggggggtgggtgtcaggtgttattaactttacttttccactcatctgcagtaggtttggtagagtcttgagccttgtaacaagctcgtgataatctagtcttaaactatttgataagaaatttctcacctcacagagcaattgttatgtttggagagtttcatttttggaaggtgtttctcccccttcctgacctcctaaagatagccagattctgcagatgtcctggattaaaagccagaaaagctaccaaagtgttcatttaaaaatccatattcagtgttttaaaatatgaatagtaaatgccattaggattacacagagttacttttatgtatatttgcaatcttgacctctttctcattagtgtggacaatcaaacttagtgaaattaggatcagaaaaatgtcacatttttattgataataaggctagctggatctcttttcattttccttaatgacctctgagggtgactcctaaagaatctatctttttcaatgtgtgtggtgtctgattcttggcctcgtaaatactaatacccattatgcagtcccaggttctaatcccaggtagtgtgtaggcactgtgctctgatgtgtgtcaggtgtcagtgagagcacagtacaaagcctccagcagggtggggcctgtgggcagcacctttcacctgctgtgcagttatggagagcagatagcactgcagacatgattgcagatagaaccacgatcacggccacatttgctacttgctaccttgcttcttactgagcacaggggaatggggaggaaactcggagacagccttacctgcagtccacagtaagaggctggtatgaaaagaaagacagtttatcttttaagctagtggacccttttagatatacgattcacctgtcagtcttttcttgtactgggatttttctgggagggctatagataatttcttattcctctttgtatctccagctcctagcacaatacctggaacatcaggcttattgattttcaaacaagtgaaaaaagagtcatgtgctttgaaggctatgtaaagtgtggtgccttctcacataagcatgggcatagacctactcaaaacagttcatattagactaagacatttaattttgccttctatttcctcagtgcaatattgttcctaatttggatctatcccaggtattggaagtctcttcagaacaatgtcagaaagcacaatttttctttggaattttttaatctgtttagtttttcatgagagatttttaatctttttctttgaagggatccatacagtttaacccacaggaagtcgacattattggcaccaaagctaatgattctccagggaacacattgaaaactctggaagaacagctaaacactctgtaccttcaaaatcaagaggaaatgtcaaaatgtcaggttgccaagtcagacaataaacaaaaacaaaaaatgaagaaaacaactagggatcacttacagaaatcttcccactgccttggggaagaaaatttaaggtattcccctagaaaacagagagctggaatattattagatgatgaggaatatgaatacagtttgttttttaagcataactccttggagattacgataattgaaggccagtctcttgaaaatgaagaccaccacggttctagtgaatcctgttccagattatctgggagaggccaaggcaggaaacctaagatccatgaaacagatgcattttttgactatcttttcaattattatgaacctccacaatatactcgtatctgcctagaaacaagtcaggtagcaggcacatgtcagtggcagagggatgtccaagctaagggagatggatttcagattaatttgagaaagtgtaggcatcactcaatcaattcgagccaagtagaaaacctggaaaggaaagaacaggttcaagaaaataattactcatcaaagatttgtactcaggatcctgagcgtaaacgaggaaaagtagattatgccaaagaatgtactaatgggtttgaaactcattgccaggagacagcccataaagctggtggtcagctgtccccaactgatggaaacagctgtctgttggaaaagactcatagttatcatattgaagattccaaatccacaaggaaaagccaagtgtccccaccccatgagtcaataggcttaggtttacagttgacagatttcttagaggaaattagtagtgattctgaatgcttcagtgaaacccttagtataaacaaagaggagaaagagaaatctgtggccacatttaatagtttctcagaaaaagaacctcttgacactgacaaaatgatcactcgcaaacaaaatacaaggtcgagtcagcagacctttttttcaaagtggaagcgtgatggtgaggaaaaatactctaattacaagtttaggacaccaggtaggaagtctgagtatgaaccgagatggatatgttcatggcctaggggtgaaagtcatttcattagacatgaaaacaacaatggacaaatgaagggacaactagcccccagatacttgtttgatgaaggctactaccaggaacccagttccagttatctaaagaggtttagtgatagtacattggaccagaaagtgaactatgggccctctcaggtgcccgtaatgtcatcaagaagtgctaggtctttctattttggtaattttcacggaagaagagggactccttggaagtcagaatataaccagaattcaagatttagaggatgtaattataactatttgaagttcaattctgattattactataatagacataatggtcaggagtatattgactatggaagctattcaggaaataactgcactggttctttaaattttaaatgttttgatgaccacttagatcaggagtatcctttttcacaataaacatgttacaagaagaaaatttaaaaccaaatgtagccatgtaattaacaactacacaggaagacagcagcattaaaaacttcagaacctgtgtgttttatatttcccaaagcttgtcaatacacctggagtcattttgacctatgctttcaactttggcaagagaaataataatttgtatttgaccctgctcaagcttttaaatgctgcttgatccaaggatagacatttctatggttcagctaaaactttacttctacgccagtgaaggagcagattaacattgagaggggttgagatggccctctatggctccttaggtgtcataacatcatcatttagtgtcatttatctccaaagacgacagcagtgaatgaataatgatccttttacatgttctttgatttggtcagaaacaccacgtgcagcaacaaactttcctgacttttatttagaaataattgtagataaaagagacgacagttagaacatagacttcttcatgacattaaagagttgcatgagcacccaccaggagaaaattaatcttattactatgtttaaatactcaaagagttgtctttttcaagacaaagtcttggaagaagaatctaaaagtggtccagattgtcctttgaggtttaaatggatagtatttaaacccattagcagagttgttgttttttttttaagaaccccatgtctttccattttagaaaaacagcaagattgaagtaatataaccactggaatttgcaaaaggaaatattgaaaaattgtggggcaccaatgatgtcacttgaaaaaagatgctgtgactattccacttcaggttatgtaaccctttcactcagggctggattacatcagtttgtaaagtcactgaatatcccccaaactgaactttattaaacagtaacaagtgcctctcttctcaatcctcagtgatgccatcaagttttcaaaaagagtaaagagaaaagcctatagttttgtagctagggaaaaatgtatatgtgtaggatttgtaaactctcaacataagcaattgatctttttacctactagtttttgacttcataaatgtttttaaattgaaatattttatggattcttaaagacttacatcttagtgcagtgcatgttttatagaaagctccgctgattcattctgccttaccttgcatttaggacctcaggggcaatcgattaccttttttttctccaacaaaactatgcctgacctggtaattgaagacattaatgagattagagactgtcagcaacaggaaaaagtcatttttaatccacagaagcagtaaagggcaacactttgatgtgacatgattcattcaaacactcttaatttgacattctgtagaaaagtaccagctgatagagccaggtagaatgccagtcattgtggttgcccagaatatcacaatgtgtgcatataaccagccttttgagcaaacgggtatgtgaaagggctacaaaagcttatttatctgaaggaagagccacaagttgtttcatcgatctcttctaatcatagagctatgttagtacatgcaagaagtcagaaatgaatgtaccatagcagatgatgtttattattaataagataataaccagtggatgatttgttggctcccttgtgttcaattccactttcaagccagtgactcttccatcaaaactagatttggcttgtcaaatctgaaaaacattgcttatggggcaagtgccttgaatgttaatgttcaaagtactgttgtccagagtagccttttgaactgctaacagcttgtattttgtcaggcaactttcagtaaccaggtattatttttctttgacgaaaacctgcctcttaatttttcatgtgtcatgccattaaaacaaagaatattatgagtttgtaatgagaagcagctatgcttttgaaaaaaatctcactgtgttctgtcacttgatttttctttgcagagtttttagacatgaaaacagtttgctgctcagtagtcagacataaaaataaattgcagaatacagcatgtgcaatttttatgtgtaatagaaccggtgctatttctatataacatttttgtcttttttttttttttttttttgctaaataccatcctgggacttagaagaaagtaaaaatactggttttatgtttacattttgtataaccctagacttgtatatgtcttataaagagtcaacctttttggtgggtaggccctaaatgaggaagataacttatcctgtactttttaattgaatggcttagtaaggagtaaaatacaactaaaatattgtaaccaccttcttaattaacactgctattgtttgttgtgctaagtggtgcaaaagtgttttctcatatctttttctatgtcctattaagggcctgagctttaaactttgtcttaaggtattttcatgtttttcttatgagttgttggtagttatgcaaaaaaactaaaaatatgtcaatgtgctttcaatttgtttaaatttctcaggtagaaagccatgtaacctggtaattttgaaaataagaatcaaataaacttatttttacttgttgcaaaattgtttaaaatagtcatttttaaataaatgctgataagtccac

SEQ ID NO: 1212 - DNA, 25635 bp, mus musculus
cctcttcttggcgtagagttttcagattgctcttgggaatcatgccgaaagtagtgtctcggtcagtagtctgctctgacactcgggaccgggaggaatatgacgacggcgagaagcccctccatgtttactactgtttgtgcggccagatggtcctagtgctgggtgagtagccgggaactgcgggggcgtctgcaaggagccagacttcgggttcttgaaggcgaatttcctctggctgtgatctgggagccacttctcaacgaagattggtgggttttctctctccgactaaatcctccctacgcatccccgccccactccagggcatttttttttttcctgctttttgtttagccttgtgactctgtatccagaccttcctcaaaactaaactccttcaggagaacaaaaatagaaacacaaacatattgtatttccctcttaatccactgtcttcaaaaactactgcctctagaagctttataacttttctgctggataccaagatgctgcagttgctcttacctcacagcaaacgaaaataaaaccctccctcgatcctgtattcccctccagctataaccccatttcgttgcttcttttatagcaaagcttctcaaaagagttgcctatattggctgtctctgcatcctgacttctaattctctcctgacctcacttcaggtaggctttccttcccacctcatcatcttaaccgtatttggctccatgttaacagttctagtggtcagttatcaatgttcattttaattctgtcagtggcatttgacagaggtaatcatttcattccttttgcaacatgttttttatttgcttccaagactccatactcacttgattttcctcctacctcgtatttccccccccccttttttttcagatggagtctcactctgctgcccaggctggagtgcagtggtgcaatctcggctcactgcaagctctgcctcccggattcaagtgattctcctgcctcagcctcccgagtagctgggattacaggcgcccgccaccatgcccggctaatttttgtgtttttagtagagacgggggtttcactacgttggccaggctggtctcgaactcctgacctcgtgatccacccgcctcggcctcccaaggtgctgggattacaggcgtgagccaccgcgcccagccttagatttttccccttgtctggctcccttttctctctcagacttttaggcattccaaggccctatagctcagtactctcacctgttctcactctgtacccaccccctaggtgatctcattcattcccaagctttaaatacaactgacatgctggtaactcccagatgttcatctttaacctgcacctctcctgagactccaattgcctattcaacatctccacttgaatgtctaatgggcctctcaaatatatcgtgctgaaaattgagttcatgaccctctacaccccctctccaattgctcctcttatagtcatccctattgcagtcagtagtacaactattcatccagtatctcagaccaaaacctggaatcagtcttgacttctgtctgtcacgtaccttacatctgtccagtccatcaggaaatcctgcaggtgctttcgtgaaaatgtatgcaggatctgactgcttcttaccacctccattcctttttctttttgagacagagggagtctcactctgtcacccaggctggagtgctgtggcgcggtctcagctcactgcaacttccgcctcccaggttcaagcgattctcctgcctcagcctcccaagtagtgtgcgccaccaggcccggctagtttttttttttttctttttttttttgagatggagtttcgctcttcttgcccaggctggagtgcagtggtgcgatctcggctcactgcaacttccacctcccaggttcaagcgattctcctgcctcaacctccctagtagctgggattacaggcatgtgccaccacgcccggctaattttgtatttttagtagagatggggtttcaccatgttggccagactggtcttgaactcctgacctcaagtgatccacccacctaggcctcccaaagtgctgggattacaggcatgagccaccacggccggcctaccacctccacttctaacactgtagtccaagctactaccatctttcacctggattggcacaatagtctcttgctctcgttgcttccactcttttccacatagtagccagagtcctgttcaaaaccaatggtttcatataacactgagaataaaaccaaagtccatccataccaagacccttgatcaggcctgtggctacctctcaggcttcattccctaacagtcttcctcttgctcatcgcacttcagccacagtggcctttttgctttttctccatcatgtcaaaagtgttcctgccccccagtgcctttttaattggtatttcttctgccccaaaaacttttccctcaatccctcccttacttcattcaggtctctgctaaaatgtaatttccttagagaacccttccctgattaccttatctaaaacagcatccctgtcactttgtcctcttaccctgcttaatatttagcacttatcattacccaaaatcatattataattattttaaaatatgttgcctcttccactagaatgtaagcttcatcagggccggaactttttttttttttttttgaaacagtgtctagctcttgtagcccaggctggagtgcaatggtgcgatctcacctcactgcaacctctgcctcccaggttcaagtgattctcttgagtagctgggattacaggcacctgccaccatgtctggctaatttttttttttttttttgagacggagtttcgctcttgttgcccaggctggagtgcagtggcaccatctcggctcactgcaccctccgtctcctgggttcaagcgattctcctgcctcagcctcccgagtagctgggattacaggcatgcaccaccatgctcagctaattttgtatttttttagtagagacagggtttctccatgttggtcaggccggtctcaaactcccgacctcaggtgatccgccagcctcggcctcccaaagtgctgggattacagacgtgagcaaccgcacccggttaatttttgtatttttaggagagacggggtttcaccatgttggccaggctggtctcgaactcctgacctcaggtgatccacctgtcttggcttcccaaagtgctgggattacaggcgtgagccaccgtgcccggccagggcggagactttatctgctttgttgtttgctgaatctttagcacagtgttagaacagtgcctgctacctagagggccctcacgtatttatcgaagaaattaattcttggtaaggaggtgtggtggaaacagcatgtgcttttgaatcacttagagttgggtctgaattcttgttctgcttcttattagatgcatggtatatctcttaccctttttaacctcagttccttcatctttaaaataggaacaacaaatctttactttaaccattcattgtgaagagtaaatgagctgacatgtaaactgcctagtgttctctaactcctctcttcacctcctctattcatcttgaattactctgaccacttgactttctctgtgatcctttaggtgcttaatttgcattatataaattttctttttttttcttttttttttcttttgagagacggagttttcctctgttgctcaggcaggagtgcagtggtgtgatcccagctcactgcaaccctctgcctcctgggttcaagcgattctcctgcctcagcttcccaactagctgggactacaggtgtgtgccaccacgccctgctaatgtttgtatgttttagtagagacggtttcgctatatgttggccaggctggtctcgaacttctgacctcaggtgatccacctgccacctcagcctcccaaagtgctggattacaagcgtgagccaccgcacctggcccattatatcaattttcaatctgctttacaactgtacctaatttgtttactgtgttttcattgttttcagattaaaattcctccaactaggatggatcatttgcatactatataatcaccctctctcttcctttttttttgttttttgacggagtctcgctctgttgcccaggctgaagtgcagtggcacaatattggctcactgcaacctccacctcctgggttcaagcaattctctcgcctcagcctcccaagtagctgggccaggctggtcttgaactactgacctcaggtgatctgctcgtcttgacctcccaaagtgctgggattacaggcatgagccacctcgcctggcctcttttttttttttttttgtaaaacagagacagggtcttgctgtgttgcccaggcaggagtacagtggctattcacaggcacaatcatggaacactacagcattgcactcctggtctcaagcaatcgccctgcctcattcttctgagtagctgggactataggtgcatgccaccacgcccagcctctctccttttcttagcacatacccacttttcccagtgcttccttgtaggcattccagtatgcttgattgtgtctcctgattctaatgcattataacacaaaccaagtgtactatgatcacagaaatacttacagaaacctgaattgcagtattgggaaggacttttgagataatatcatctaactcatctttcaaatgaggcaaaagtctccaaaggaggaagtgatttgccaaagatcaccagggtagtaagagagctgggtccaaataccaaggtctcctgatagcaagtcatttttagttggaacattcaataataggtttcaataagcatagtaattgtagtagaaaattctagtgctagggatcccactcaaaacttctcaggatattttgcagtgactcatttgctatattttgccatgactctagtgaccaaatctctccattccttcagactgccagttagagaaattgcccatgaggccccgggaccggtcccgtgtgattgatgctgccaaacatgcccataagttttgtaacacagaagatgaggagactatgtatctgcggaggtaagaggttgatgctccctgtttaggatttccctattgtgttggagtctgtttctgaataatataaatatcacatctattgttgaacaggtcagttggtcccaatactttgacatttgtggtggttttctaacttctgttaatgtagtaatatctttattgtgctttgttgaaatggtgctcacatgtgattccattgctttttttttttaattgagatggagtctcactcactctgttgctcaggctggagtgcagtggtgtgacctcggcttaccgcaacctccacctcccagattcaagcaactctcttgcctcagcctccccagtagctgggatgacaggcgtgcgccaccacgcccagctaatttttgtatttttagtagagacgcagtttcaccatgtcggccaggctggtcttgaactcctggcctcaagtgattctccctccttggcctcccaaagtgctgggattacaggcataagccactgtgcccggcccctccattgccatttgatagccgtagtttgtttacaatttacaggtttgaatgagttcattcaacctgtaatcttgtggagcataccgtgtgccaggcactgagctaggtactggatctgtgaagatgaataaggtatgatttttaccattaaagagctcatgactttgagggaatgactcctattgtgataggaaaaaatactggtcttctgaacgaaaggaaaaacaggtgggagtgggtcatttgtcctgaatggtggccaggaaaggcttcaaaagatgatggcatttgtgtttagcctgaactaggatttcaccaagtagatgaagggaatgaagagcattccaggtggaaggaatatggaagcattaaaagcatcaaacatggtgtgctttagaaacctgaattgtcgtttgtgactggagcacaggttactttacaggaacggcatcatgcatactagggtgaggacagagtaaagtgctgaagtggacaagtttggccttaatctgtaggcaatgaagagccatctccgtttttttttttttgacggagtttcgctcttgttgcccaggctggagtgcaatggtgtgatcttggctcactgcaacctccgcctcccaggttcaagcgattctcctgcctcagcgtcctgagtagctgggatttcaggcacctgccaccacgcctggctaattttttgtatttttagtagagatgggatttcactatgttggccaggctggtctcgaacttctggcctcaggcgatccacctgcctctgcctcccaaagtgctgggattagaggggtgagccactgcgcccggcctatctctgttttttaagcaggggtgtgatgtggttagctctgttttagatttgggagtttggtatatatgggaaattgaaacctgggaagggataaaattacagagtgtggagcaagcagataggactgaatatttaaaaggcagacaaaagaattggaacagaaccagaagaacctggtgatgcagaaaataggagagagtatcaagaagtgtgtgggggtgtggctaggggacggtcagcagcaggtgctagaagtcatggaaaggtcaatcctagggaattaaaaaatccatccattcatgcaacaaatatttcatttaccgagctcctactatgttccaggtactatcctagaagtctggaatatataccagtgtattagttttcttttttttggagacggagtctcgctctgtcacccaggctggagtacagtggcgcgatctcggctcactgcaagctctgcctcccaggttcacgccgttctcctgcctcagcctcccgagtagctgggactacaggcgcctgccaccatgcccggctaatttttttttgtatttttagtagagacggggtttcaccgtgttagccaggatggcctcgatctcctgacctcgtggtctgtctgccttggcctcccaaagtgctgggattacagacgtgagccatcgtgcccggccgccagtgtattagttttctagagctgccatagtaaagtactacagcctgggtgtggtggctcacgcctgtaatcccaacactttgagaggctgaggtgggtggatcacttgagaccaggagttcgagaccaggctggccaacgtagtgaaaccccatctctactaaaaatacaaaaattagttgggcatggtggcgcgtgtgcctgtaatcccagctactcgggaggctgggataggagaattgcttgtatggggaggcagaggttgcagtgagctgagattgtgccactgtactccagcctgggcgacagagtgagacactgtctcaaaaaataaaaaaaaaataaagtactacaaattgggtggcctaaaacaagagaagttgtttaatagttgtggaggctagaagtctgaaatcaaggtattggtaagtccatgctctctctcaagattgtaggggagaatccttccttgcctcattcctggtttttggcgtttaccagcaatccttggcattccttggcttgtattgtaaatgcatcactccagtcagtgcttgtatcatcacatggcattctccctttgcctgttcttttcttataagggcaccaatcatattggattaagggcccatcctcctccagtatgacatcattttaacttaactaattatgtctgcaacatcactatttccaaataaggtcacattctgaggttcctggatggatgtggatttttttttcttttttcttttttctttttttttttttttttgagatggtgtgtgctaccatgcctggctagtttttgtgtttttagtagagatggggtttcaccatgttggccaggctggtctcaaactcttggactcaagtgatcctcccacctcggcctcccaaagtgctgggatcacaggcatgagccactgtgcccggccagaatgtgaatttttaagggtcactatctaacccagtacaaccagtaaacagcaaagaatcctgcccttatgaaactttagtgttgaaccagaaaaaaactataggctgacatctagctacatgttttctttctttcttttcttttttttttttttttttgagatagagtctcgctctgtcacccaagctggagtgcagtgatgcgatctcagctcactgcaacctctgcctcctgggttcaagtgatcctcctgcctcagcctcccatgtagctgggattacggttgtgcaccactatgcctggctaatttttgtatttttagtagagacagggtttcaacacgtgaagctgctcttgtgagcctccttctccttctttggccttctcaatcctttggattctttttcttctgcctgcccctcaagtattggtattccatgcggttctgaccttgcttttgtccccactctctttatgccttccttgggcattcttgtcaccttacatggcattagttacacttttatgctgatgataaaatctaaatctgcctactgtgccttcctgtgtcccagaactgtatagccagttgcctactctacctcttcacctgatgtcctacttttcagatccaacatgatgaaggccaaacttatcatttctctactgtggacagtaccacagatcgattcgctcagcaccactctgacactctttttttttttttttttgagacggagtctcgctctgtcacccaggctggagtgcagtggcgtgatctcagctcactgcaagctccgcctcccgggttcaggccattctcctgcctcagcctcctgagtagctgggactacaggtgcctgcaaccacgcccggctaattttttgtgtttttagtagagacggggtttcactgtgttagccgggacggtctcgatctcctgacctcgtgatccgcccacttcggcctcccaaagtgctgggattacaggcgtactctgacactcttctgctacaccctcctatacacgagtgtctgtaaagttagggtgcatattccagtccccttccccccaacaactaagattctgaatatgacttagctttggccaagcaaaagagatggaagtagatgtcagctgatgggtgacttcaagccttttttaccctttatccttattccatcctgcttcttgggaaatggacatgataattggaacactagcagccagcctggaactgggaaggagaggccacaagaattgcagagcctttgccctgctatccttgggtctcaaccagtgctcagaactgccttcctcctgatgttacatgagagaacaagctcttttgttgaagccattgcagtcaggtctctattactattagccaaatgctagtccttcttttccttcttcttatgatgacaccaggattcatgcagtggccccagccagaaatctaggagtcagtctctctttgtctcatctgtccccaccatcccaccatcatcccctgcatacatctagtcactcaccatgtactgtcgattctgccttctaatctcttttgtggctgctgcctcctgttcagccctgctgcactgccgttatttcagtacccaaaatcacttacttagactactgaagtggcctcttacctggtcttttggtctctagttttgctctcctccagtctatcctctactgcttgaattatctgaaatacacattatgtcagtcacctgcttcaaatctgttagtgacccttcatcacttatagcaatgcctttgaaacatttttagatgaaaaatcctttctttaattaaattcttacccagaagtataaataagactgataagcagaaagctgctctgagtggggaggagtctagcccaatccattaaggactcctccttcctccccatctgatttcatttagggatcattgtggagtacaaggaaaacactcctagttggctggataaaaatataagcctgaatgcgctctatgatctgtccatcttcatcttctggtactctcttgatttttttttttttaaagaacaaacatttatcattttatgtattttctgtgggtcaggaattcaagagcaagcttagctaggtgattctggtctctcatgaagctgcgattaagaagatgactatgtaaacagtcatctgaagtctttttttttttttgaggcagggtctcactctgtcacgcaggctagagtgcagtggcacaatcacagctcactgcagtctcgatctcctgggctcaagtgatcctcccacctcagcctcctgagtagctgggaccataggcatgtgccaccatgcctggctaatttttaatttttttttgtaaagacagggtcttcctatgttgcccaggctgttcttgaactcctaggctcaagcaatccccctgccttgtcctcccaaaatgctgggattacaggtgtgagccaccgtgcctggcctgaaatcttgattagggctggagagtcatcttccaaggtgtctcatatggtaggcagttgagtgctaactgttggcaagaagcctcagtttctcaacacagggatctttccataaggctgcttgagtatcctcatgacatggcagctggcttcccataatgtaagtaattcaggagagcaaggcaaaagccgcaatgtgttttatggctatgactcagaaggcacacacagttgtttctgtgatgtccttttggtgtcacaagtcagcgctattcattgtgggaggtgactatacaagggtgttagtaccagggacaaggatcattgggggccaccttagaggctagctaccacagccagaatggagaattttttttcttgagatgaagtctcactctgttgcccaggctggagtgcagtggcgcaatcttggctcactgcaacctccacctcctgggttcaagtgattctcctgcctcagcttcccgagtagctgggattacaggcatgcaccaccatgcctggctaatttttgtatttttagtagagacggggtttcactgtgttggccaggctggtctcgaactcctgacctcaaatgatccacccgccttggcctcccaaagtgctgggattacaggcgtgagccaccgtgcccggccgagaatgttttgttttgtttttggtcacagagtcttccctatctcatatattccttgagattcaggataggaaagaaaatcaaggtcaattatcccaaacatctagctcatattaatcacttctttaagtcataccacttgaaattcttacctcatttacattaaagtctcactatttcaataagatgaactttttgagagcaggaaccctgccttatttttctgaaacccttaggacagacatcttgcctgcttcttggcacatagttagaaatagatacatttttataaacttgacaaaatccagtttgtcattggtacttgaagattaactcattgagaaatatgcggccccatttatttgatatttctatgtgttttgaaagcttgaacttacgggattggccgacttcaggattctaggggaagttcattctctgtatggtgaatctctcccttcagtatggggttgaatttagtcccagtgggaccagagagggtatatagaaccaaaaatattattagtgccctggtccagtgatgtcaatgaattggagcacctttgacataagtaatacttgtaaatggagaggcagaacattaaagatgatggtcagcacagtctgtatagttatatcccaagcagtaccactttgtgactttgggcaagtaatcttttaggcccccaatttccttatccttcaattgggaaaataatacccatgtgttgtcaaagagcaactggaagtctcctacagtaccagaaagaccacaaatagttataatgactttggaaagtactttggcaacatccagtatagctaaaggtgcatataatgtgtgccttataaattctgcttttcatgtacaccttagcaaagtgattctcaacctttgctgtgtgccagaatcatctggaggagttttttgtttgtttgtttgttttaatgcgaatgcctcagctttaccctcagagatttcgtttctgttttccactttttttttttttttgagacagtctcactctgttacataggctggagtgcaacggcgcgatctccgttcactgtaacctccgcctcccaggttcaagtaattcttccacctcagcctcctgagtagctgggattacaggcacccgccatcatacctgggtaatttttgtagagacagggtttcaccatgttggccaggctggtcttgaactcctgacctcaggtgatctgcccacctcagcctcccaaagtgctgggattacaggtgtgagccaccacacccagccgagatttagtttcttttaaattgagttatagtctacataccataaaagtcaccattttaaagtgtatgattcagtggttttagtatgtttgcaagattgtgcaaaagattggacacctctgccctagagaaaggaatgctgcacagaggccaagaaaagtctgaacagacaggccttgctggatttagataatgtgctttttgtccaatcacatttctacatggttgtcaatcatgcctctgtaacaaagcttccataacaacccaggaggacagggtttgggaggcttctggatggctgaatatgtggaggttcctgaagggtggcgtgtccagggagggcatggaagctccacgccccttgccccttagctcaccctgtgcatctcttctctgtatcctttgtgatatcctctgtagttaactggtaaacattaactatttccctgagttctgtgagctgcactagcaaagtaatcgaacccaaagagggggtcgtgggaaccccaacttgaagctggttggtcagaagttctggaggcctgactaggcatggcggctcatgcctgtaatcctagcactttgggaggccgaagcgggcagatcacttgaggttaggggttccagaccagcctgaccaacatggcgaaaccctgtctctacaaaaaagttgcaaaaattagccgggcagccaggtgcggtggcttatgcctataatcccagcactttgggagcctgaggcaggtggatcatgaggtctggagattgagaccatcctgaccaacacagtgaaaccccatctttactaaaaatacaaaaaattagctgggcgtggtggtgcgcacctgtagtcctcaggaggctgaggcaggagaatcgcttgaacctgggaggcggaggttgcaatgagccaagatgtgccactgcactccaatctgggtcacagagtgagactcagtcttaaaaaaaaaaaaaaaaaaagttttggaagcctggacttgcgactggtatctggttagtggccggtcttggggaccaagccgtcaacctgtggtatctgacgctgtgtccgagtagacagtgtcagaactgaattggaggacacctagctggcatccatttattggagtgtggggaaaaacccacacacatttggccacagaagtcttcttctgtgttgaaggttgttgttgtggtgtgagatcagaggaaaaacccaggttgacagagtttttcccaaacagctggcattcaccaataaaccatctgcctcagttgtactgcctgcctgcccgcttcctcgttcctccctcatctctgccctggccagttaagttggaggggaaccttaggaaggacaggggaaacagaggaagtagaaattcttttttttttttttttgagacagagttttgctcttgttgcccaggctggaatgcagtgttgcaatctcggttcactacaatctccacctccagggttcaagcgattctcctgcctcagcctcccaagtagctgggattacaggcacgtaccaccatgcccggctaattttttgtatttagtagagatggggtttcaccatgttggtcaggctggtcttgagctcctgacctcaggtgatccacctgccttggcctcccagagtgctgggattacaggtgtgagccgccgcacctggcccccatttttaaattggtgtatttgtctttctgttgttgagttgtaagaattctatgttatgcatactagtcccttatcatatatatgatttgcaaatattttctttcatcctgtgaattgttttctcacttttttgatgatattctttgaagcacacaagttttaaatttttatcatcccatatatctgatttttttcttccattgcttgtgctttaggcatcatatctaagaaatggccaggcgtggtggctcatgcttgtaatcctagcactttgggaggccgaggtgggtgaatcatttgaggccaggagtttgaaactagcctggccaacatggcgaaaccccatgtctactaaaaacacaaaaattaaccatatgtggtggtgcacacctgtagtctcagctgctcggggctgaggtaggagagaatcgcttgaacctggtaggtggagtttgtagtgagccagccaagatcgtgccactgtactccagactgggtgacacagcccgaatctgtttcaaaaataaaagaagaaatgtttgcctaatccaagcatatgaagatttgcagctatgttttcttccaagagttttataattttacttcttacatttaggtctttcattcattttgagttaatttttgtatatagcatgaggtagggggctaaattcatccttttgcatgtggctatctagttttcccaggaccttttgttaaaaagactgagtttttcccccttaatggtcttggcacccttgttgaaaatcagttaaccatatatgtatgggtttattttagactctcagttctattccattgacctgtatgtctgtccttataccagtatcaccctgtctttattactatagctttttagtcaattttgaaattgggaagtgtgagttctccaactttgttcttgttttttcaagattgctttggctctactggatttcttccaattgcatattaattttaggatcagcttaaatttctgtgaaaaagccagctgggattttgaaagggattgtgttgaatctggaaattcattcgaggaatattgccaccttaacaatattaagtcttccaatccatgaacatcaaaatgtgtttacatttatttaggtcttctttaatttcttttggtaatactttttagttttcagtggacatttcttgcacttcttttgttaaatttattctaggtgttgaatagaagtagtgagagtggcatctttatcttgttcctgattttagggggaaagctttcagtctttcactattaagtatgatgttagtttatgtggtgctatgatttgaatgtgttccccaaaagttcatgtgttggaaacaatctgtctgccctatgaatggattaatgaggctctgctcttatgcatggattaacgttgctgtcatgtgagtaggtctgttattgcaggagcggctttgttttaaaatcgagctttctcatacttacttgcccttctgccgtgttatgatgcagcacgaaggcccttgcccaatgccggagccatgctcttatgcttcccagctttcagaactgtgagaaatcaatctcttttatttataaattatccagtctgtggtattatgttacagtaacagaaaatgcactaagacgtgggtaaacagatgggggtttttcagagatgccctttattaggtagaggaagttcccttctattcttagtatattgaaggggttttgacttttgtcaagtgctttttctatgtgtctattgaaatgattatgtttttctctttccttctatcaatatgatgtgttaatttttttagctttattgaggtataattgacaaaaattgtatatgtttaagggatacagcttgatattttgatatacatatacactgtgaaatgatcaccacaattaagctcattaatgtatctatcacctcacagttaccattttctttgtgtgtgtaggtagtgaggatacttaacaaatttagaatgtacaatacagtattgttaactatagttatgatgctgtacattagatctccaaaacttactcatcttgcgcaacagaaactttatatccattggacaacaacctcccatttcctccaccttcagcccctggcaatcaccattctactctctgcttctatgagtttgactattttggattccacaaacaagtgagatcatgtagtatttgtctttctgtgtttggcttatttcatttagcataatgtcctccaagtccatccatattatcacaaatggcaggatttccttcttttcataaggctgaataatgttctgttgtgtgtgcatgtgtgcgtgcgtgccaccttttctttatccatttagccattgatagacatttaggttgcttccatatcttggctgttgtgaataatgctgcaatgagcatgagagtgcacatatctctttgagatactgaactcatttcctttggatatataccaagaagtgggattgctggatcatagggtagttctataattttctgaggaatctcccatactgtgttccataatggctgtactaatttacattttcactagcagtatataagggttcccttttctccacatcctccctaacatttaatttttgtcttttttttttttttttttttttttgagacagagtcttactctgtcaccaggctggagtgcagtggtgcaatctcggttcactgcaacctctacctcccgggttcaagtgattcccctgcctcatcctccctagtagctgggactacaggcgcatgccaccatgcctggctaattttttgtatcttagtagagatggggtttcaccatgttggccaggatggtctcgatctcctgaccttcgtgatccgcctgcctcggcctcccacagtgctgggattacaggcgtgagccactgcacctagccttgtctttttgataacagccattctaactggaatgagaggatatctcattatggtttttttgtttgtttgtttgtttgtttgagacagggtcttgctctgttgtccaggctggagtgcagtgacgcaatcttggctcactgcaacctctgcctcccaggttcaagcgattctcctgtgtcagcctcccaagtagctgggattacaggcatgtgtcacaacacccagctaatttttgtatttttagtagagatggggttttaccatgttggccaggctggtcttgaactgctggcctcaagtaatctgcccgcctcggcctcccaaagtgctggcattacaggtatgagctaccacgtccggccctcattatggtattgatttgcatttccctgatgattagtcttttcatatacctgttggccatttgtatgtcttggagaaatgtctgttcaggtccattgcccatttaaaaaatcaggttatttatttatttgctattgaattgtatgaattattatgtgagaaaagaagattggtttgaccacagaaaaacctaaaatttccacatggtggaaaaagtcaaagacaaatgacaaactagagaataaacaaggccccttaattattgcaagtttccttaatataaaattaaaaggtaactgaataaacaaaggacatgaactaacagttcaaaacaaagaaaatgcaaatgactattaaatatatgaaaagatgtgtaactttactcctaaaaaaagaaattcaaattaaaagattccatttttcacatgtgagaatggcagtgatgcaatttaacggcatccagtgttggtgagactgtagggaaacaggaactctcagtatattggtagtgtgagtctaaattggttcaacttctatagagagaaatttggcagcatctaccagaatttaaaatgtacacacttctaggaatttgtccaacacgtaaaagacattttggtttatctatacaaaggaatacaatgcggtccttgtaaagaatgaagtaactctttatctattgatatggaatatatatatatatttaaccaagttatatttttaagtgaacaaaagtagagaacagcgtacatttgtctaaaaaaggaaaaaaatattttctttatgtaccagtcagagttctttgcttatatatgcatcagctatctctaggatgaacagaagaaaccagaaacagtatttgcctctggggaagggaactgggtgggtggaggatgagtagggaagatattttttgttttatactcttatgtataccatatgcatatattgcctattacaaagttgaaacaaggggaggggaagtgaagagaccagtcaggaccgtttgttacagtcgtccagggagttgataatggtggtgtaggctaagatagtggcaggaacgtggagacaagcagacagattcaaggtcttttcttggagataaaaatccatagaatttgctgatgaagtaagtgtgggagatgaggggaagagaagaatcaaggatgagtcccaggtttctgttaaacagccgtgtgggtggaattgagtccttgtgtatatgacttggtgtctaaggtggtattgtgtgggctcttgagcttgactgcctgggcttaaattcaacctctgcttcctagctccacgactttgggcaagccatgtaatactctgtgggcctaggttcttcattcataaagtgggaataataatatgacatacctcacagagttgttgtaaggattaaatgagttaatacatgtatactttttttttttttttttgagatggagtctcgttccgtcacccaggctggagtgcagtggcgtgaactcggctcactgcagcctctgccttccaggttcaggtgattctcctgcctcagcctcctgagtagctgggattacaggcatccgccaccacgcccagctaatttttatatttttagtagagacggagtttccccatgttggccaggatagtctcgaactccttacctcaaatgatccacccacctgggcctcccaaagtgctaggattgcaggcgtgagccaccgtgcccagccgagttaatacatgtatactttagaatagctcttggcacatagtaaagggtttataagtggttgccgctattattgttgttgttattactacaactactattgctacctatgattatgactacactgctcctcctcttcctcttcctttgtcagggagatacctgacctgtatcaggggctccataaatgtttgttgcaggaagggaggaatgttgaaccaatgagttgacctatgaaatgaaaacttttttttttttttttttttgagacggagtttcactcttgttgcccaggctggagtgcaatggctcgctctcggctcaccgcaacctccgcctcccaggttcaagcaattctcctgcctcagcctcccgagtagctgagattataggcatgcaccactgcgcccggctaattttgtatttttagtagagacggggtttccccatgttgaggctggtctcgaactcctgacctcaggtgatccgcccgcctcagcctcccagagtgctgggattacaggcgtgagccaccgtgcccggcccccaaatgaaaacttttgaaagggcctcttagcgtttgaagaaatgggatagtaaggttgatacataatgagatttgttcatatctttttaacttccattttctgtgcagacctgaaggcattgaacgacagtacaggaagaaatgtgcaaagtaagtattaacaatgtgggtttctccaagcataggcaagtagaggcataatgtgttaggaaaataattatttggatacaactctccattatgtctttttttttttttttgagacagagtcttgctctgtcgcccaggctggagtgcagtggtgcaatctcaggtcaccttaacctctgcctcctgggtttaagcgattctcctgcctcagcctctctagtagctgggattacaggcacatgccaccatgcctggctaatttttgtattttagtagagacagggtttcaacatgttggtcaggctggtctcgaactcctgacctgagttcatccgcccacctcagcctccaaaactgctgggattacaggcctgagccacctcgtccgacccccattatgtctttatccttatcaactgccttcagacttcaactatgcacaaataccaatatgttccccaaagaggctagtcaaagttgtatctttgaccagctggccagaaaaatgaatttttttttttgagacagagtcttgctcttgttgcccaggctggagtgcagtggcatgatctccactcactgcaacctccacctcccgggttcaagcagttctcctgtgtcaacctcccgagtagctgggattacaggcacctgccaccatgcctggctaatttttgtattttgagtagagatggggttttgccatgttggccaggctggtcttgaactcctgatctcaggtgatccacctgcctcggcctcccaaagtgctgagattacaggcgtgagccaccacgcccggcctaagtgattcttatcaggtagaggtagttttgggagacactgagaagagccagtcattagtttatgccacaaacagaaatattcccagagtctaagcacactttgcaaattgctgttttgggaatttggattatgagacctcgcagaaattcactgtgtcattgcaggtgtggactgccgctcttctaccaatcccagccaaagaatgctcctgttaccttcattgtggatggagcagtagtcaagtttggccagggctttgggaaaacgaacatatatactcagaaacaagagcctcctaagaaggtaattaccattgaaggagagactgcttaatatagctctagatttagctcatgttttgaaataagattatagtgatgagaaactgctctttatggatgtattctttttatttctttttctttttttgtctttttcttattttatttcttttttctttatggatatattcttatactttatttttattttttaaaagttaaaaacgatttggggggtatatagatgcacatatttatggggtacatgagatattttgatacaggtatgcaatgtgtaatcacatcatggaaaatggggtattcatcccctcaagcatgtgtatggatgcattctttattaatcgggtgccatttttgtgtataaacagatgctatgtaattgtaacacctgttatgtgttctctctttcctacagttgcctcatgactaaggttagaaattgtatggtttttactcacattaatttccttcaaattttcttctttttatggagagatatcatgtgttattttacaaatttttttttgaacaattaaaaacaatgaattaggctaattaaaaaatatattccaagctgggcatggtggctcatgcctgtaatcccagcactttgggaggcagaagtgggaggatcacttgaggccaggagtttgagaccagcctgggcagcacggcgagaccctatctctacaaaaaaaagtaaattggctgggtgtgatggtattcacctatagttctagctattcaggagactgaggcgggaggatcactttagcccaggagtttgaggttacagtcagctatgattgtgccactgcactccagcctgggtgacagtaagaccctgtctcttaaaaaaaattaattggccgggtgcagtggctcactcctgtaatcccagcactttgggaggccgaggtgggcggatcacctgaggtcaggagttcgagaccggcccgacaaacatggagaaaccccgtctctactaaaaatacaaaattagctgggcatggtggtgcatgcctgtaatcccagctactcaggaggctgaggcaggagaatcgcttgaacccaggaggcagaggttacggagccaagattgcaccattgcacttcaggctgggcaacaatagtgagactccatctcaaaaaaaaaaaagtaattaaaaataaattttaagaacccatgatggaccatgcatagtgtctctcgcctgtaatcctagcactttgggaggccaaggcaggaggattgcctgaggccaggagttggatacaagcctgagacattaagcgttaaggatgcttttttataccttctgtccttcttttttttttttttttttttttttttttgcgagacccagtctctacaaaaatgtaaaattagccaggcgtgggggcatatgcctgtaatcctagctacgtgggaggttgaggcaggaagatcacttgagcccaggagtttgaggttgcagtgagctatgattgtgccactgtattccagcctgggcagcagagtgagatgctatttcaaaaaaataaagtaaattaaaaaaaaataagagcctttgatggcaaatgttagaaaaatatgtaaataaaaacattggcacttttaaataggtcatcctgtcccaaagaggtagtgtttcccccaatacccacagcccctcacacaggcgtgtgcgcacacactcacggctcatggatcctgttttggtgaaccggactgacttcttcttgcctgccactccaggtgatgatgaccaaacggaccaaagacatgggcaagttcagttctgtcaccgtgtctaccattgatgaagaggaagaggagattgaggctgtaagtgtctctggtcttaaggaaactggaatttggggagaagggtacgaggaaaggggactctagagcgggagccttggagtagtggaaatattagagacttcacttttagaccctgctctgctgataagaaactatgggctgggtgtggtggctcacgcctgtaatcccagcagtttgggagaccgagacgggcggatcataaggtcaggagatcaagaccagcctggccaacatggtgaaaccccgtttctactaaaaatacaaaaaattagccgggcgtgttggtgcgcgcctgtaatcccagctactcgggaggctgaggcatgagaatcgcttgaacccgggaggtggaggcttcagtgaaccgagattgcgccagtgcactccagcctggggacagagcgggtctctgtctcaaaaaaaaaaaaaaaaaaaaaaaaaaaaaagaaaagaaaagaaactctgacagtgagccagttcctgtttccttgaatctcagggacatctgtaaaatgaaaacgaaggagttggatgttgaatgagatcagtgattttttcctccatgctatttttagagatgccttagagggcaaagtgctcatccctcttaatttgagaaactactggactgaaagatttcagtttccttccagcccaactcgtggtttgtgagtctgtcctcagtagtagtagcaattacctttatggttcttcagtataacgatattgatggcaagatgtcatctgctgttttacatatgttttggttaaaacgtaaatgctactgaagaatcacttgaacccgggaggtggaggttgcagtgagccaagattgtgctactgcactccagcctgggcaacagagtcagtctctgtctcaaaacaaacaaacaaacaagcaatcaaacaaaataccctaagtgctcctggattactgaaaagatggagaatggaaaaggaacagagtcctgccattttagtcatgatttcatgatttgagtagtatacattatgacttaacgtctttgttgttattccttggtgagacttccggtttaaggatgctccttttttccttcagagggaagttgctgactcatatgcacagaatgccaaagtgattgaaaaacagctggagcgcaaaggcatgagcaagaggcgactgcaagagctggtgagtagcaaggggtagcaaggtgctggggccctatcatttggatgtcttggtctgaaagacctttcagcaggcagggaaatcttttaggaaatctgttgggaggttttagagtagttggctgccagttttataaccctggtctgtgactgtcagtataccctactctgtagtagtgaccccaggatctaggccttaaatgatgatacttgttatagccctaactaggatgatattttattttctgtattttatttttattttatttatttatttattttggagctggaatctcactttgtcgcccaggctggagtgccgtggcgtggtctcagctcactgcaacctccgcctcccgggttcaagggattctcctgcctcagcctcctgagtagctgggactacaggcacgtgccaccacacctggctaatttttgtatttttagtagagatggggtttcaccatgttggccaggctggtctcgaactcctgacctcaggtgatctgcccgcctcgggctcccaaagtactgggatttcaggcgtgagccaccacgccaggccaggatgatattttaatctgcttcttgtggtccaagatcaggagttaaaggtcagggtttctggacgttgtcccaggatgtaatggcacatgatagggctaccttggtagtaccaggattggggctggtcattgcttcttaaagcactggtggttttctgcactattcatgggctcatcttagagcatatggatctgtgtatgatggtgcctatgtatttttttttgacaattacttaaaatatttcatcaaaatcagatatcactatgttggtgtctcatccaaaggtataccagtctctttgtgtctgtagtgagtttttggtgacagaagtggtgggtcctgggagctgctttaccttgccatagtcgtttagaacagtgcttctcaacctttcaaaggcagaaagaccagtgctttccttttttcaaatttccatgaacagatttgtaatttataaaatacaataaaaatgaattgtctcaatttttatcagattttaaaaattactattgtgtcaaattgctataaaagcttctaaatgcttactatccatttttgtacatattttgtgtggaccaataacaaatagttcatagaccatataactttaagtagcactgttgtagaatgatgttcttcctgttctgccaagaatagcatactggtatgccacagtattggttccctcagcctgtggggggcgctggggctgctggaatccctgcgctgatttcctgtggccacagccttgtctttttgcccattttgcctacaaatagcattttttgtgtatgtgctataacatcagaaaggttggaaagtagatgttagaggtatataatgatttgggaaccatgattctagtttgtacactaaatgaacattaagggagagtgtttgggttggttagaataaggaaggaaaataatttcatgtcatgtatcaagacatatgctttttttttctttctaggctgaattggaagccaagaaagcgaaaa

SEQ ID NO: 1213 - DNA, 19010 bp, mus musculus
ggggcatttgttgggggcggagctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtgcccggtcggccgctggcccgggagagggcgggacgagtccgcagcgcggggaggatggctgggaatggggctgccccctttctttctcaggttctccttctatctcttcgcctgaatggaagtcgcatcatcctggttcatccattcacccgaaatggggagagcccctcccggccaaatcctgggtgggggtgaggaaaagaggggactccccaaacgggaagggtttaggtcagagctgtgagatgataatgggagggaagagcgacggtataaagaatgaggaactaaaggtgtaattggggagaaatattaaatagtgaaggagacatgagggatgggaatattattcatggaggcgagttgggggagagtgcagggtgattaatggtacaggagggtagatcgagagcatcctattttgagagcaatgggtagattttttgtattcgttagagttttgaattcttaagttcaatgggcaaggattttgttttaagatgtgttggacgtgggagaaacttgttgctaaatcaagatttcgtggcacccacaaagaccagcgttggcttactaagttattgccactagatctgttaaaaaatgggtgatcgaaaatgatgcacaaacctggtaaactgcagggctgctgtaaagagcaaaacctgcgatttttccttgctccaggtggttctcatttccaagggtttttttaaaccgcgttactattatgtttgactaattctgagcattgggctgcagaagaatattttctcctgggtttttacaagtgatctcatattttaaagcccagccttcttcaggaactgtgattctttcaggtatgacagaaaactgatttgtactaattttattttccttatgcatttcttaaggtggtaattcgaagattacctcccactttgaccaaggagcagcttcaggaacatcttcaacctatgcctgagcatgattattttgagtttttttctaatgatacgaggtaaaaaaaaaaaaaaaaggaaaggggtaaatgaaaaaggtttctttcattctttttatcctactgtttttcatttgatttttgagcttgtctttaatatatgcatacttgtaattgggccagacacctgcgagtacatttacataattgctttcctctctgcagtttgtatcctcatatgtatgccagagcatacatcaactttaaaaaccaagaggacattattttgttcagggatcgctttgatggttatgtattccttgacaataaaggtgagtcctggtaactgaagtaaaaagggaatttctttgtcatttgtatgtttaagacaactcgtgcattgcgttgcttcctagagttttacacatttaataagcttattgcagtcttataaatagacgtgacttttcacagtccttggttatttttattaacctactatttttttagtttgatcaactgagtgaaattgcaactgttttctcctcgtgtgacacattttttgccctggcttaaacctgctgttttgactgtagaatttcagccgcagtactgataagtgactcttaaacttgtttgataagttttaaatatttacttcttattttgcttcgaggacaaacatttatttaattcaaatccattaagccaacagttcccaattgggatactgtttaacattctcacaaagttgtatataattaaaacatgaaacttgatacatctcggcctggtgtggtggctcacgcctgttatcccagcactttgggatgccgaggcaggtggatcacgaggtcaggagatcgagaccagcctggccaacgtggtgaaaccccatctctactaaaaatgctaaaaaaattagccaggcgtggcggtccacgcctgtaatcccagctacttgggaggctgaggcagaagaatcgcttgaacctgggaggcagaggttgcagtgagctgagatcacgccactgcactccagcctggcgacagagcgagactctgtctcaaaatcgaaaaaaagaaacttgatacatctcttactttatatccagaaaggtccagtctatagggaagacacatttctactttaacactctattatctgctacctacatttagccagagaatatctaagctgccatttgccacttttctttttggtttgcaattataggtaaatagtgtgtcttcttgttttgttttgtttttttcaatattacttcaaagttggtaaaaattaaatttttgtcagggactatgccagtaaaaattgaaggattgccactgtttgtccaacttttattaatctccccaagccagctatttttccactccaactattttattccagtagatatttaactagattctagttacttagcctggaaatctgagttgtgtttaattttttccttttttaaaaatctcttacatgtaagttatgaatcttgtcaatttattgtttatcttttgagatagggtctccacccaggctggagtgctgtggcgcaatcagagctcactgcagcctggaattcctggactcaagcaatcctcccacctcagcctcctgagtagctgggactacagatgtatgtcaccatgcctggctaattttctttaaattttttatagagatggggtctcactacgttgcccaggctggtcttgaactcctgggctcaagtgatttccccccccccacctcagcctcccaaagtgctgggattacaggtgcgagccaccatacccagctcaacaccacttattaaagagactatcctttcctcattgtgttttttgtttgtttgtttgttttgttttgtttttaaatcttagagacaaggtctgcttatgttgcccaggctggattttattgtttttttttaatatcttgttcacctagccttaaacagtcacactttatgtcctcatcacttaatgcctagacaaccactgtctctaaacttacaggattttccatttttttcattcttgtataattcagtctattatattgccatgaaattaatctttttgaaaataatgatttaaattaacagttgggggaaaaagtccaaactccttagcctggtagtcagggtcctccatattctggcctcacttctgtttcttcagcctgtcttccacaatttccctctgtttcagtctggtttatctattccttctcaaatatatcacagttttgttttttggtttttatttttgttttttttctttttcttctctctctctctctttttttttttgagacagagtcttaactctgtcgcccaggctggagtacagtggcacaatcttggctcattacaacctccgcctcctgggttcaagcaattctcgttcctcagcctgccgacttagctgggattacaggtgtgtgccgccacgcccagctaatttttgtaattttaggagatggggtttcaccatgttggccaggctggtctcaaactcctggcctcaagcaatccacccgcctcagcctcccaaagtgctgggattacaggcgtgagccaccatgcctggcctaatatatcacagttttgaagctaatctgattctctactcactgggattcccaacataatttttcctccatgactgctttgcagtgccttctggtcaattctgtttatttttatttttctgcttatgtctacatgccaatgatttaaggataggataccttgtttttgacattctgtgacagggtgcttgtgaatttttttcccattagtcacttggggtttttgtattgaaatataactcacctataataaaattcatcctcttaaagcgtacaattcagtggtttctggtatattcacaaggtagtacaaccatcagtactaattccagaatgttttcatccctccaaaaagaaacccatatctattagtagttacctcccattctctccctccagcccctggcaaccactaatctactttatgtatctatgatttccctccatttcatataaatgtaatcatacaatatgtggtcttttctgactggcttcttttacctagcacaatgttttcaaggtccatccatgttgtaacatataacatatatcattacctcattccttttgcatttttaaaaattgtaaaaatacacgtaacataaaatttaccatcttaaccattttaagtgtacagttcagtagcattaaggtatattcacactgttgtgcaacaatcttgggaactttttcatcttgaaaaactgaaactctttacccattaaacaactccttatttcccttcctccagcccctggcaaccaccattataccttgtgtctgtatgagtttcactactgtaggtaccacatataggtggaaacatacagtgtctgtctggcttatttcatttagcataatatcttcaaggtgtatccatgtcgtagcatgtgtcagaattttcatcttttttttttttttttttttttttgagatggagtctcactttgttgcccaggctggaatgcagtggcgcgatctcagctcactgcaacctccgcttcctgggttcaagcaattctccagcctcagcctcccaagtagctgggattacaggtacccaccaccacagctggctaatttttttgtacttttggtaaagatggggtttcactgtgttggccaggctagtttcaaactcctgacctgaagtgacatgcctgcctcagcctcccaaaatgctaggaattacaggcatgagccactgcccccagcctcatttttaagactaatattccagtatatgtatataccacattttgtgtatccattcatctgtcaaggggtattcgagttgcttccactcttggctattgtgaacaatattgttatgaacacagatgtgcacatattcgagtccttgttctcactgcttttggatatataccgagaaatggaatttctggagtcatttggtaattctatttttattttattatttatttattttgagacagagtctctgtcacacaggctggagtgcagtggcatgatcttggctcactgcaacctccacctcccaggtgcaagcaattctcctgcctcagcctcccaagtatctgggattacagacacctgccaccacaccctgctaattttttatgtttgtggtagagacggagtttcaccatgttggccaggctggtctcaaactcctgacctcaagtgatgcgcccacctcggcctctcaaagtgctgaggttacaggtgtgagccactgtgccccgccggtagttcttttttgttttgttttgtttttttgagatggaatttcgccctcattgcccaggctggagtaagtacaatggcgcgatcttccctcattgcaacctccacctcctgggttcaagcaattctcctgcctcagcctcctgagtagctgggattacaggtgcccaccaccacacccagctaatttttgtatttttagtagagatggggttttaccatgttagtcaggctggcccaataattctatttttaatgttttatggaactgccatactgttttccatgcagctgcatcattttacattcccaccaatacatgagtgttccagtttctccacatctttgccaacacttgttattttctgctttttgatagtagtcctcctaataggcgtgagatgatacctcattgtggttttgatttgcatttccctaatgactagtaatgtggaacatatttccatatgcttgttagccatttgtatattatctttgaagaaatgtctattcaagtcttttgaccattttttaaattgggttatttggttttttgttgttgagttataggagttctttatatattctcgatattaccccttatcagataatataatttgcaaatatttctcccattccatgggttgccttttcactctgttgattgtgtcttttgatgcatagaagtttctaattttgacgtagtccaatttatctattttttactttttttaaataagagatatactttatatttttgttttattgtggtaagaacacttaacatgagatctaccctctgtatttttacttttgttgcctgtgcttttggtgtcctggtgtatttttttttaagtgttaacagatttttccccagctttattgagctataattgacaaataaaataatatatatttaaattttactatgtaataattgttttttcttttttctttttctttttttttttttttttttaccaggctcgagtgcagtggcacaatctcagcttactgcaacctccgcctcccaggttcaagtgattctcctgcctcagtctcccaagtagctgggattacaggcgtgcactatcacgcctggctaatttttgtatttttatttatttttatttttatgtatttatttttttgagacggagtcttactctgtcgcccaggctggagtgcagtggcatgatctcggctcactgcaatctctgcctcctgggttcaagtgattctcatgcctcagcctccagagtagctgggattgcaggcacgtgccaccacgcccagctaatttttgtatttttagtagagacagtgtttcaccatgttggccaggcaggtctcaaacttctgacctcaggtgatcctctcatctcggcctcccaaaatgctgggattataggcataagccacggtgcccagcccaacgtgataattttatatatgtatacattatgaaatgtatacattatgaaatgtatacatattgtatacatatatacattatgaaatgtatacataatgtatacatatatacattatgaaatatatacaatcaagttaacacattcatcacctcacataacacatcacctcaaatagttacacttttaaaaaataacagctttattgagatataattcacatgcctgaaatagtcacccttttaaagtatacagttcagtgaattttagtatattcataggcttatgagcctatcaccacaatctaaatttagaacatgttcatcacccctaagagaaaccccacccattagttgtcactcctcattcttctcaccacttctaccccaaactccaggcagctactactctacgttctgtctctatagatttgcctattttggagatttctaacattttaaaatgaaaaatagtttgtagggtctttttcacattaaaatatcacattttataagttgaatttatatgaatattttactttcatgccgtgttgtttcactatgttatcagtgtgaatttgtggctccttttgtagtatgttgattatggttgtgccagtgtgctttatgcctttgggagaccctcttcagatgactgccatcaaaagagtcatagaaagcaatgggttgattcccttatatccacttttgacattttctttgttatagcaagtgtggtattttttttctaaacaggtcaggaatatcccgctatagtagaatttgcaccttttcaaaaagctgcaaaaaagaagactaagaaaagagataccaaagtcgggactatcgatgatggtacagtatagctctaattatataatgctattgctgtggggtttttaaaaataatatctttgtgagagttaattcgaccccaaaattttaaattagaaaatatacaaaataaagtaagtgagaaatgttatttgccgatggaagctttgcttaattgttagactagagagagtttcttgcacagaatctctgctctctttggctagggcatttcattcttcaaccattgaacaatataatgttgactattgagtaacaaatcaccataggtttattgattagaagatagtggaaaggccaggcgtggtggctcacgcctataatcccagtactttgggaggccaaggcgggcggatcatctgaggtcaggagtttgataccagcctgaccaacatggagaaaccctgtctctactaaaaatataaaattagccgggtatggtggtgcatgcctgtaatcccagctattcgggaggctgaggcaggagaatctcttgaacccaggaggcggaggttgcagtgagctgagatcacaccattgcactccagcctgggcaacaagagcgaaactccatctcaaaaaaaaaagaaaaagaaaatagtggaaaaaaatcaggtttcaaagtttaacaggtgcttcttgaggcctcaccatttttatgattatttatttgacttttggtttccattatatttataaagaagaaggtttgaactgtcatgggaaaatttccatacccaggtaactttgtataaagtagctgaagttgtcactcctattttctggtctttggatatacaattagctacacacatagtattaggttgaacaggaatagaagaactgaggccaggcgcggtggctcactcctataatcccagcactttgggaggccaaggcgggcagagttgctgaggtcaggagttcgagaccagcctggccaacatggtgacaccccatctctactaaaaacacaaaaattagctaggcatggtggcgggcacctgtaatcccagctgcttgggaagctgaggcagaagaatcacttgaacccgggaggcggaggttgcagtgagctgagaccgcaccattgcactccagcctggacaacaaaagcaaaactccgtctcaaaaaaaaagaaagaaagaaagaaatacaagaactgaaaaaccaaaataattgccatttaaggtacactggctccagattttgagacctctgtaatgttatgttagatagctgttacacaactctttatgttggataaggactaggaccatattttatatcagattgttactttagaatcatctagtttaatttccatcatttgttactattacaggtattttataaagaaaacacggtaaggactcaataacacatagctgtgatactggttttattacagatttagatctggaagacttgatcaagtgacacatagaaacaagcaatataatggcttagatgtgtcaccctttctgatgttagaggtctaggagagaactccaggaattcccatcacctcaagtgccacatctaggacttctctctaatttatctttttggaacacctaacttagtttagtaggacagtgacttttaaaagcaaactatgtaatacccctagtggttctgttataatgcatggcgtctcatttttcctgaccccatgttataccagattcctatagtgagtatcagtgataggagtcctgagagcaagtgaccaattaagctctaaatagtctaccttgtgggtatggtttggttttttttaatcttccacgaagtaaaaaattatcttctttgataaatcagtattgtagataatgtcttctttttttgtttaaagtctattatattttctgtttcctcaaatgattatttagatccagaatatagaaagtttttggaaagttatgccacagataatgagaaaatgacatctactccagagacactgctagaggaaatagaagcaaaaaatagagaattaataggtaagtgggcaaaaagaatcagggcaacagtcttttcatcacagtacctaagtctcctacctccatcagttgctagctgtgtgacttcagggaagttactagtttctctgagactgttactgtaaattgcagatggtaatacctgcctcacagcattatgagaatccattaaagtgggaaaaattctttgacctatttagtttcacacaaatgtaatataaatacaaaaagttcgatgactgataaggaatgtttagacagtggtaagcctttgaaggtcaattggtattttctagtaataagttcatattcctaaaaaaattttgacttgaaaatacgaaaaaatgaaattagttactgcaaaattgaaaactacttgaggaattctagcttggatcttggttctcagtaataggctgtcactactgtatcagtagctctaaacatgagcataatctttgacccaggatttctactcaggaatttatcctaaggaatatgtggggtttttttgtttgtttgtttgttttttttgcttgcttgctcgctcgctctctctctgtgtgtgtgtgtgtgtgtgtgtgtatgtgtgtgtgtgtgtgtgtgtgtgagagatggagtcttgctctgtcgcccaggctggagtgcagtgtcgcaatctcggctcactgcaacttccgcctcctgggttcaggcgattctgccgcagtctcccgagtagctggaagtacaggtgtccgccaccacgcccggccaattttgtatttttagtagagccggggtttcaccatgttggccaggctgatctcgaactcctgacctcaagtgatccgcctgccttggcctctgaaagtgctgggattacaggcatgagccactgtgcccggccaggaatatgtgttttaagatggctgtaaggccaatagcttattcagaatgttgaaaatgaaaaatattcttccaaaacttgacttttattaatagatggatagtacaagcctatttctggtaactttcttagaataaattcccagaagtggaattatggggtcaaaaggattagatatttttagccccttccccccaacttcttccagttgaacaagtttacactcctatcagtaaaacaagagaatgtcctaagtacttaattctcatcagttgggaatgactcttttaataaattattttgttgttttaatttgaatttctttactttttaaaaggtattttaatcccgtattgttgaaatcgaatgctgtaaaacttctttctgatattacaattgtgatctttctgcataaggggtgtacatgttttcccaccttgggtggttggcagggaatgtcagaaaatggaatcgtttctaggggttgataagtatgattaataatctgtttacatttatgtagctaaaaagacaaccccacttttgagcttcctgaaaaacaagcaggtaaatcttttgtctttatagttctctcaatactttaatttctttgctttgcattctataaacattttaagagcattgggtttctagaggagaaatagctgctttttccaccattactctttaaggatttgccttcttggtctcactctctagcctgctccttcactctggttgttggaccaggagttcactctacaaacgtggaatgttcttaggttgtcccagagacactcatttgatattctgaaagcctctggagagatagtaaggcagcagtggaagaataatattagcaggttctggtcttcattgtctttcgttttctgggtggagtggggataacggtggtagaatgccactttgtagaaagtaggaaggaaagattattcagttggggcctaccatgacttcaggatttattagggttttggtgatgattattttatttgaaggcttgtgttgatgtttctttctagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtataagaatgttgaaactgactgcatgttgctaaaaattgcacgtatctacttctttaaatatgcatgcgtcttgtgttggtgtaaatgaattttttgttttgtttttgttctcttttggggggaagtgatccaataaaaatctttcctgtaatagtattagtttttaaatttaagatcatttaaaaggataaagtagtatgttatttcttcagtgcagatctgtgctgtttttgtcattgaaaatgttggatttttagactattgtcctctaaattcatagtaaatgagggcttagggctggctggcatgatttatggttttttttcagctttttcttcataattgatacatgaagttacctcatctgtttgttttccactgtcttcaggtacacaggtttctgttacaagctgtgaatcagaaaaatgtaaggaccaagtacatgatacagagcatctagtatcatgtcacacacacaggtcttagctaataagtccttttggtggtggtggtggtagtgttacttgttgaaaaccccttcaggttgacttgagtcttcttaaaagctgagctattttattataaatttctactttaaaaggaagcccaggtgacttcctgatgctctgctgtgtgcccagaagcttcattgacctacagccagaggacaaccatgcctatatagttctttctcatcttcttatatgcttctcataactggctgccttgtgggaggactagggataaataccctgcaatatgtgcctttccctctcacatgactcccgtagtatcttcctgcatatatctgggaatctgtgagcagcagattcggattcatgcattgcatttgggaagaagaaaacctgcagaaagatcccaaccttgccacttcccttctaagggcatggcttgggcagcccttgtttcaacatatttcctggggaagtactagtacctagcacttcagataaagtcaaagaaaatctcacagagagggtggcagggtctccttattttatttcctgaaaactcagcagtttatgtagcaagggttccctaagtctctacggggctcattactgatgatgaggggcttgggggaggatggagtttctcatcttaattctttccagcaatctctctgtctgctatgccacaagtgacttgacttgctattcctaacaatcagcaaggcagaaggtagagccagccatgctagagacattcattaatgttcttattagagtaatgaacaccttggtttctaataaggatgttcattggagaaataagagcacttccaatgaaacctgcacatggtatcctcattttacactggtgccttctcagtgtccattttggactcaccatttgcagtggctgtctgtgtgccaaaatgctttgtgcttatgtcttgtggtgctttgccttttgcttagtaatttacatgatgccttcaccctgagatgaaccttgtgtgataccttcactctgagacttgaaattcttctattttgcctaagaatctctctgattatccgacacttggaggtattctcgagagattcatagcagcaatgtaaaaaacaatggcatttttgaacatgcgtaaatatggcattaaatacagagttcctactcagtagagatggaacttcactatttggttgtataaggcctttagatttttaaatcaaatgccaaataattcttgttattaatctctaatggcaagataattgtaccatcataagtatgttattctcaggctcaaggcaaaattattcctgcaatggatctctcctttggtgaccaaggtatttgtcattccaagtactacataaaaacagtcccaacagaaacgatctgcctatcacttaaaatttgtgggctgtttcccattaagttatatcaacatgctggtttgctacagaagcatactttgaagtatgcattggttcacttaaaggttgacccatttaaagccaaaggaagccgggcacagtggctcacacctgtaatctcagcactgtgggaggccgaggcagaaggatggtgtgagcccagaagtttgagaacagcctgggtgacatgatgagaccttgtctctacaaaaaaattaaaaaattagccatatgtggtggtgtgcatctgttgtcctagctactcaagaggctgaggcaggaggaccacttaagcccaggaggtcaaggttgcggtgagccatgttcatgccactgcactccagcatgggcaacagagtagtgagaccctgcctcagaataaaagccaaaggagtcttgatcctattgccacaaagtgattaaaccacttcgttcaagtggataacactttaacattaatagcatccttttagtaaattactactcttatgcactagttgttcacctgaaagattaagtgtacctgcagagatagggggctttgtctagtctaaattttaaatatttggtatactgggtttttaatagaagatagtgtcccagccttcaaaataaaaataaacattttatctttaaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagaggtcagtagtcaaggactctttgttatgtttgatttatacatgctagttttgctgctatgtcctggacatgtacctgaattaagataagctgttttatgcagggcagggggatgaggaggaacagtttcagaatattcttgtatcttaatctgggtgaatggttttggggttttgttccttcttaaaacactagtatttttcactctgctctaaaagtgcaacctcattgcaggggccaaatcagaatcacagtgttcctgcatttgtgattacaagatctttcagggttctgtctcagatttgtttttcatgcagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggtgctgcttgtcattaaacttgtttatgagggtttttttcccttttcctgcaagtgtaaagaaagtgtaaagggcactgttattatagaatttttaaaggggaactttaatcatctgcaacttttttttttttttttttttgagacagagtctgactatgttgcccaggctggagtgcagtggcacaatctcggctcactgcaagctccgcctcctgggttcacgccattcttctgcttcagcctcccaagtagctgggactacaggcgcccaccaccacgcctgacttatttttttgtatttttagtagagacagggtttcaccgtgttagccaggatggtcttgatctcctgacctcgtgatccacctgcctcagcctcccaaagtgctgggattacaggcgtgagccaccacgcctgaccaacttttatttcagtcttggctgggcttttattaacttactatagaaattgtaaacatacacaaaagtagaatagagaatagtatgatgggccaggtgcagtggctcacacctgtaatcctagcactttgggaggctgaggtgggtggattgctagagcctaggagttctagaccagcctggccaacatggtgaaaccccgtctctactaaaaatacaaaaaatcggctggatgtggtggcgcacacctgtaatctcagctactcgggaggctgaggcagaagaatcacttgaacctgggaggtggaggttgaggtgagccgagatcacgccattgtattctagcctgggcaacagagcgagactcagtctcaaaaaaaaaactggccgggcgcggtggctcacgcctgtaatcccagcactttgggaggccaagacgggtggatcacgaggtcaggagatcaagaccatcctggctaacatggtgaaaccccatctctactaaaaatacaaaaaattagccaggcgtggtggcgggcgcctgtagtcccagctactcgggaggctgaggcaggaaaatggcgtgaacctgggaggcggagcttgcagtgagccgagatcgcgtcactgcactccagcacgggcaacagagcgagactctgtctcaaaaaaaaaaaaaaaatcgaatagtatgatgaactccatgtactgtacccatcacccagcagttcatagccaaccttctttctattctacttcatccctacccctactagattattttcaaacaaaccctgcacataatttcttccttaaatacttcagtatatgagataaatactctattaatattaccctagtagcattttcacaccaaaaaaaactaacaataattccttaacgtcctgtctattcagtgttcatatgttcccaattgcttcattaatgtctttttaaaattaattaattatttattttttgcgatggagtctcgctctgtcatctaggctggagtgcagtggcatgatctcagctcaccacaacctccacctcccgggttcaagtgattctcctgcctcagcctcccgaatagctgagactacagcctcaagccaccatgcccggctaatttttgtatttttagtagagacagggtttcaccatgttggccaggctggtctcgaactcctgacctcaggtgatcctcccgcctcagcctcccaaagtgctgggattacaggcatgagccaccgtgcccagcctaatgtcttttttttaataggacctaaacaaattccacaaattatgcttccttgaaatgtcttcttcagttctcttttgtttttagtttattttttgagacagagtcttgctatgtcacccaggctggagtgccgtggtacaatctcagctcactgtagcctcgacctcctgggcttaagccatccccctacctcagcctccagagtagctgggactacaggcatgcatcaccatgcccagctaatttttaagtttttttgtagagatgaggtctccctatgttgctcaggctggtctcaaacttttgagctcagccgatcccctcaaagtattgggaataaaggtatgagccactgcacccagccaagttttcttttaatctaaacaatttccccttctcttgttttcctaccatttgttgcagaaaccaatttgtcttgtagggcttttcctgttctgaattggcagattacatccccatgctgttatttaacgtgttcctctgtcttctgtgcttcctttaaaactggcacttagggcctggcatgatggctcatgcctgtaatcccaacaatttgggaggccaagtcaggaggatcacttaagcccaagagttggaaagcagcctgggcaacatagggagagcttgtttgtactaacaatgtaaaaacagcccagtgtggtagtgcgtgcctataatcccagttactaggtacctgaggtgggaggatcgtttgagtctggaatgtcgaggctgcaataagccttgatcatcccacttgctcttcagcctgggtgacagggtgaggccctatctccaaaaaaaaatttacccaagcatataaaatagtaattaccaaatggttgcttttctttggagatggagagaggaagtaggcaagttgtcatttaccgtgccctcacatttttggtcttaaatgacttcacttgagcatatattcatacataactatgactcttaaaaatcccatataaaagcttagtagcattgttgtaatggtaacatattttattgtacttcaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaa

SEQ ID NO: 1214 - DNA, 1554 bp, mus musculus
gacttatcacaaggggcatttgttgggggcggagctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtgcccggtcggccgctggcccgggagagggcgggacgagtccgcagcgcggggaggatggctgggaatggggctgccccctttctttctcaggttctccttctatctcttcgcctgaatggaagtcgcatcatcctggttcatccattcacccgaaatggggagagcccctcccggccaaatcctgggtgggggtgaggaaaagaggggactccccaaacgggaagggtttaggtcagagctgtgagatgataatgggagggaagagcgacggtataaagaatgaggaactaaaggtgtaattggggagaaatattaaatagtgaaggagacatgagggatgggaatattattcatggaggcgagttgggggagagtgcagggtgattaatggtacaggagggtagatcgagagcatcctattttgagagcaatgggtagattttttgtattcgttagagttttgaattcttaagttcaatgggcaaggattttgttttaagatgtgttggacgtgggagaaacttgttgctaaatcaagatttcgtggcacccacaaagaccagcgttggcttactaagttattgccactagatctgttaaaaaatgggtgatcgaaaatgatgcacaaacctggtaaactgcagggctgctgtaaagagcaaaacctgcgatttttccttgctccaggtggttctcatttccaagggtttttttaaaccgcgttactattatgtttgactaattctgagcattgggctgcagaagaatattttctcctgggtttttacaagtgatctcatattttaaagcccagccttcttcaggaactgtgattctttcaggtatgacagaaaactgatttgtactaattttattttccttatgcatttcttaaggtggtaattcgaagattacctcccactttgaccaaggagcagcttcaggaacatcttcaacctatgcctgagcatgattattttgagtttttttctaatgatacgaggtaaaaaaaaaaaaaaaaggaaaggggtaaatgaaaaaggtttctttcattctttttatcctactgtttttcatttgatttttgagcttgtctttaatatatgcatacttgtaattgggccagacacctgcgagtacatttacataattgctttcctctctgcagtttgtatcctcatatgtatgccagagcatacatcaactttaaaaaccaagaggacattattttgttcagggatcgctttgatggttatgtattccttgacaataaaggtgag

SEQ ID NO: 1215 - DNA, 306443 bp, mus musculus
ctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 1216 - DNA, 306443 bp, mus musculus; identical to SEQ ID NO: 1215

SEQ ID NO: 1217 - DNA, 122878 bp, mus musculus
tgacccttcgctcgcgtgctacacatccgggcttctgctactagtgagaggaagatggcggccgcggctgtggtggttcccgcagagtggataaagaactgggagaaatcagggagaggcgaattgtgagtgttcgggccggaggcaggcgcactgccgggccgggccagggcgtcagctgcactctcacctgtagtgggaggttgagggggaaagatgtaccccctcccccacccgggcggcgggcgtggatggtcgtctaggagtttcgaactcggggagaggtgctgtttaccgccgcggacctccttccttccctggcctcccagaaatcgctactgcctgcggtagctcggcttcctttagcctcttagtagaactcttattccgcccctgcaggtctccgcgctccctcttggtctctttttgtgtccccctcttcgcttgatctcacttggctcctttatctttatggggctgagccggggcaattcggactttccatctctctctgtgccatttcttcactctgcacccgttggactccgcagtttggagcttggcgcctcctctgcctgaagtccaaggagggcgaaccgtcccggattcccctcccctcctcttcgcccgctgccgcgaagcccggggcgccgcgaagaacccggtttggcacctctcgccctcccggggagcggtctctcgactgtcccggcctcgcgtagcgccgtggggaagtgtggcagggattgccgctttccctgaagaaccaccgacatttctttgctccgtcttttcaccttagagctatttcgggttggattcaactttcgtcattaaatgttccctaaaccccattttatcctgggactgcaactaattctggcagctctccaagcttctccagtacctaggataacgcgtttcctttagtcgtgaaactttcccccgtaacaccgaaaacagtaatttgccatacccctagtcttctcgcccccacgttagagcgctccctcctccccttcccctggaaggagtcgtttaagcagcaaagcaaacctcagatataagaacaaatattaataacatctcatttccttctctgggtcgcttttagatgctaaagctcaaccctggatgaaattaaccctcgttagccatttttgtcgtccttgcccacccctctccatttctagtagccagtttaccgtggctcatgctaaagattcaaatctttgtaacttcgttacttggaacgaaacacgaggaacgcgttgccggatcccgcgcttgtaatagtgccagcctatgtggcttcctcccccgcaccccccgcactgctgtatgaagtcttaacagtgtgagctctagaattccctaaataagcggctgtcttagccacttaagtagctgagtgaccttgggtaagttccttaaccacttggactgtttccccttgagtaaattgggaataataagtactctactcaaaggattgttgtgaagactaaataatgcctgtaaagcacttggcttatagtaagtgctcaagtgatagctattaaaagtaatattattccaacctttagatatttaaacttctcaggacagctcatgcacttaaagtctgtaccactcaggttagcaattaattggtctctgacttattcatgtgtgtttattcttgcactgtaatgaattgggaggcctttgaaatatagggactatgtctcatatttcttttggtttaacacatgccccgcccccccagcctatgcttagaatgcttattggtttattaattgtcagagaaggctatttgataaatcttcgtttttaactataatgaacattttacaaatcctcgtatgtgctagttaacaaatagctgtcaagtttgatagctagttgacaaatagccatcaagtttggggaaggcaagatgggaagttacccagccagaccatcatcttcatcgatattagggtaatcccccaaaactgataaaagcagttcattgttttgtttactttcaaagccagctcatttatttaggggctgttatgtttgtagattgctcagcttcctcctttcagctactgttttttgacagttttacttttttttttcccccttgagacggagtctcgctctgtcgcccaggctggagtgcagtggcgcgatctcggctcaccgtaacctccgcctcccacgttcaagcgattctcctgtctcagcctcctgagtagctgggactacaggcgcgtgctaccacgcccggctaattttttgtatttttactagacacggagtttcaccgtgttatccaggatggtctccatctcctgacctggtgatccgcccacctcggcctcccaacagttttactattattgctgccaccttagcatgagtggtattagggctataaggtgaaattctgcttggcttctgactggtaatggtttgagaaaaagtgatgtaggagatcgaaatacttagataaaatggaattttaggttcacattatgtatatttacataatacatgctatctgtcatagttcttatgtttgaagagctgcttaaaaactgttattagaagccgagcgtggtggctcacgcctgtaatcccagcaaattgggaggccgaggcgggtggatcacctgaggtcaggagttccagacaagcctgaccaacatggagaaaccccatctctactaaaagtacaaaatttgccgagcgtggtggcacatgcctgtaatcccagctactcaggaggctgaggcgggagaatcgcttgaatctgggaggcggaagttgcggtgagcggagatcgcgctgttgcactccagcatgggtaacaagagcgaaactctttaaaaaaaaaaaaaaaacaaaaacccaaacaaaaacaaaccaaaaacaacagcaaaaaaacctgttattagaacttacgtgtatgtagttattgcatgacttgtggaatgtggattgaattatagtagatccaaatcagtatagtcagttttatgattgcattctgttacaggaagagaatttaaaattgtgtaacataataagctattttaaatagttaaacacatcaccatccagtacttagtttcagtttatttgacctgttttccctctatgaaactttgttgcatatagcatgtctttggagtttttgtgtcttcctaaagataggtgttagcattttcatattactaggcagaatacgtggtggtgcaaatatattacaaaaaacctttttcctttgtctgaaaacagcttctgaaatataaaacagcaactggaaatgttaaaaatgaaggtagtgtgccaccacattattagtgaagctatagatttggcgtttagaatatgaccaatatttaaaattataccttgggtgaatttttcctttttaacaagataaattagcagataagctttaacttgactgaaaattatctttttaaaaataatgtgatatatttcatgaggttgttaattcatttcttgtctgtcacttcttaccagcataaatcttttctgggggtggtagtcagctagtgttgaaagcaacataagagatgtatggggcattttataactttcagatagggcaaattcttaactgtacgccatgaaaaacaactgtctattaaatggaaggtcttgactttgaagaatgttttattaggtaattagagagaaaagtaaaactgtattttgcctatctgaatggtccatccatcacatatctagatatcccattatgtttccagagataccaattatgtttttaatgctaaattatagaactcttaaagagtgacctttaaagtgatcttaaagagggatcagaagggcaaaggaggactaccaaaatgtaattgtaatttccaataatacttatatctaaatgcaaactcttccaaattctgaaagatatgtatttaatcacttaattttggaattagttttagtttcttgattattttatattgacgtagaacttgccatgatgaagctaataaacttgcatgtactggtagatccagtgtagaattctgtttttggtagaaatcattaacacagtgaactcagcatttctttgttacaggcaaccttaatggagaattgatattcgaagctcttaatctgaagatgctagcctcatgttaatacttagtctaattttgaaatacttacgtttgttgaatatcatctgtttgtttgaatagcttatttaggtatcaattagaaagttttgttaggtcttaccttattaatggtagttacaataaagttttaaaatttaattgccaaatgttttgattgttgttctttttcttcttctgctactacatgattttagacattctagaacttatttaagtatatttggttgttcagaacatgccatctgatctgaatttcttggaggattccaggtaaagggatataatcattctaagaaattttagtcttggtggttgagtcttttttcctcgcaaagttgctccaaattcagccaaagctttatctgaaaccttttcttgatgtctcagttttcatttagcatttaatttcccatttcgacctgtattcataagctaagtataagtcttagtctgttttcctgggaagagaaacattcttcacaaaatgttgaagcaatgtcaggaggttgtataggctactactttgtttgttaaaaaaaattattctgtaatgctctaacgtttaggtagggtgagtgctgtcaatatacttgtgcttttttcctactgtaagtgcggcaactcctgttgtcttttttttttttaacatttcctgtttccttttcttttaaatgcatgtttctacaagataaaactgtgttgtcccagtattcatttttgtgggttatgtttctgttctacaaatgataatagaggtagcactttatttaactacatttaacctttttgttgtcttgttttaaagaattaagtgaagcgtaaatgaacatcagccttctatatatgaaagccacatttgagatgtgagcataatcaagtagtttaagcttgtgactctgtttcctttttactggaaaatgggaacaagtaagatgaaaagccgtatactcatgttaagaagtattcacaaaataccttttaagtccttgaaggaacttcagacattttattcagttttccatacatcttttgacagaaagtagattctgtcctcattctcagggacctgagacagcatctccataatagcactaaactattttaaaagtagaaaaaatgaatgcctggcgtggtggcatgtaaggtggtgtgcactgtggcacacacctgtaatcccagctacttgggcaactgaggcaggaggaaggattgcctgagcccaggagagctctgggcgacatagcgagaacctatctctatttttatttttaaaaaattaaattaaaaagtggaaaaatggtaaactcaagtatttgaaagttattaagggattaaaataatttcaatttggactgagacagaaaatttgattatttttaagcgatattaaagtgggcaactattagaggtagttttgttttttcctctccctataatttaggttagtgacctaaaaccattaggcaggtgtatagtaagacaaatgtaatgttcagaaacagtttctttaagaatccttggtggacttctattagtgaattacttagggagaagagcacagatacatctacttgttggggaaaaatctcagtgtttgtttttagtttcttgttataactaaggaatacctgttttttttttattaaaaaatttatttttaactaagttttttttgagacagggtcttgctttgtcacctaggctggagtgcaggcgatcacggctcactgcaggcttgaccccaccaggctcaagggattttcctgcctcagcctcctgaattgctagggctacaggtgcatgccaccatgcctggctaattaaaaacatttttttgtgcgggtgtatgagtagggatggggttttgctatattgcccaggctggtcataaactcctggcttcaagtgatcctcccccctcagcctcccaaagtgctgggattacaggcatgagccactacgcccagccaaaggaatacctcttttatactagggaaatgtaagtatctattatgcaaacaaattgccttattgtaataacctttcaatggttccatatgcaacttgagcaaatctttgagattctaactaatagttcatgatgacattgtcatctgtgtcctaatgaacatgtttgtagcctggtgactgacaatatagaattatatttcaattatttcttaaagttatgtaatgatgactgtaccattagtctaggtaggagtttgcaacactgatgcaacctcttccccgcaaccattggaaggctttttgcaaaagacatgcattaagattgttaaatagaaatgaaactattgaaaatgtgaggaagcaagtgcattgttataaggagaagttttttttttttttttttgagacagggtctcactctgttgcccaggctggagtgcagtggcacgatcttggctcactgcagccttgacctcctgggctcaagtgaataaggaggaattttaaacaattattttatttctctttctttctcatcctttccttttcctttcctctttttcttttttctctttttctatatgaaggaatatttgaaattgcattttagtagcccgagtacaaagggaaagatgagttactttattctgttaaattcttctttcaaagacatggtgcttcctgctattattattattattttttttgagacagagtctcactctgtcgcccaggctggagtgcagtggtgcgatctcgacccactacaacctccgcttcctgggttcaggtgattctcctgcctcagcttcctgagtagctgggattacaggcattggccaccaagcccggctaatttttgtagttttagtagagacggggtttcaccatattggctaggctagtctcaaactcttgacctcaagtaatctgccctcctcggcctcttaaaagtgctgggattataggtgtgagccacggtgcctggcccctgctattatattctaaagagaattgaccctataagggaaatgagaacccaaagagggaattgttttaatacttcatagtaaatattgaagcaaccttgatatacttatatatctcctctccacaaaagacctagatggcatttttaggttatatcttctgatgctagtctgaagcagatgttatttctgtgttgcctggtggaaggaagattgattttgttttatattccagataaacttatgttaggtttaacgtattttgtgaaattagaagcttaatcgtggttttttttttttttttttttttgagatagggtctcactctgttccccaggctgcccaggctggagtgcagtggtactacgatcaccactcactgcagcctcgacctgcaggctcaagtgatcctcccagctcaacctcccaagtagctgggattataggcatgtgccaccacacttggctactttttttttctattttttttttttttttgtagagatggggtctcacttgttggctaggctggctaggctggtcttgtactcctgtgctcaagtgatcctcccacttcggcctcccaaagtgttgggattacaggcatgagccagcatatccaactttaaccagtgttcttaaccaaccactgttctcttctcaacccattagaaggcctgtctagttctccagggaagtagttgaaagtacttgggatcaaacttaaaccagcttaccatttgtaaggtactctcagaataatttttttagtgagaaatgtttaatagctaaatgacattttctttctttgtttttgtttttgagatgggatcttgctctgtcaccctggagtgcaggctggagtgcagtggtgcgatcatggctcactggtgtgatcttggctcactgcagtctcaacttcctgggctctggcgatcctcccacctcagcctcctgagtagctgggcccacaggcgcgtgctaccatgctctgctaattgtttgtgtttttggtagagacagggtttcaccacgttacgaggctggtcttgaactcctgagctcaggtgatattaccaggctggtctcgaactcctgagctcaagtgattcacccaccttggcctcccaaagtgctgggattacagacgtgagctactatgcctggcctgacattttcaaactaaatatttaatttagtagatgctctccattgcccttattttttatttttattttttctgagacagagtctcgctctgttgcccaggttggagtgcggtgatgcagtcttggctcactgcaacctctgcctcctgggttcatgcgattctcctgcctcagcctgtagagtagctgggattacaggtgcgcaccactgcgtccagctaatttttgtatttttagtggagacgaggtttcatcatgttggccaggctggtctcaaactcttgacctcaactgatccacccaccttagcctcccagagttctgggactacaggtgtgagctacagtgcccggcttccattgcctttttattttttggttttgaacatatttgtgaaacctagaagtgaattgttgaccagcaaaagtttactctgttgacttttaataaccttaccctgctcatcctgatgatagggtattgacataatcagaaggcacagaggtgagctgcaaggttatgtataatctgcaaagtagataatctctctgtggatgattgtaatctggcatcttatttagccttagatgtgatatataagcaggttctgtaagtcttaaaattatttgtttcattgactagaaaaaggattactagatataaaagagtaagaaactcttctatatgaattcattggctctctttaaagccttgtgcaacatggaagaatttttttctaaattgtgaaatgtaatgaaaatacagagaagtcatgaaacctcaatatagagcttaaaataatcactgtaagatgcacccccatgtaacttacacccaggtcaaggcaacatactgtttgttcccgatcaaacctttcccacctctcatgtagtaaacattatcctgacatttatggttttcctcttgatttttctctttttttaaccttgcatcttcaactcaaagaaactttcttgattttctttgcagtgtcattacccaatatgtttaatttttttcttgaacttcatataaatgaaatcattgaatatttatcctactgtttctggctgcttttgttcaacagttatgacttttaagattcatccatattgtatgtttgcagttcattgattttccttttttttttagttcattcattttcatagttgcaagatactccatcgtataccagtatttgtttatttttatgctgtcttgttaaacatttttgttgcgtctagtttttggctattactaacagtgccaatagaaacattattatacaacagttttggtgtatacaagcatgtgtttttgtggagtatatactaggtgtagaatctctgggttataggttacactttagctctgttagatattgccaggctatttcagtgtacactcccaccagcagtgtatgagttgaccttgtttcacattgtcactatgtttgatattgtcagacttaaattttttgtaaatatgtatgtaattttactgtggcttatatttccatgagcatctttttatatgttattggtcatttggagtacttctttttttttgtttgtttgagacagagtcttgctctgtcgcctagtttggagtgcggtggtggcgtgatcttggctcactgcaacctctgcctcccgagttcaagcgattcttgtgcctcagcctcctgagtagctgggattacaggtgtgtgccaccacacctggctaatttttgtgtttttagtagagacagggtttcaccatgttgggcaggctggtcttgaactccggacctccgatgatccgcccgccttggcctcccaaagtgctgggattacagacgtgagccaccacgcctgtactggagttcttatttctttttgtgaaaggtctctgtcatatcttttgccttttttgttattgagttgcttgagtttctttcactgatttgtaggggttctttatatagtctgtatttgagccctttttgggttacactgcatgtgttacaactgtcatttttttttaattttaagttctgggatacatgtgcagaatgtgcaggtttgttacataggcatacatttgccatggtggtttgctgcacctatcaacctgtcatctaagttttaagccccacgtgcattaggtatgtgtcctaatgctctccctccccttgctccccaacccccaacaggcaccagtgtgtgatgttcctgtccctgtgtccatgtgttctcattgttcagctctcacttatgagtgagaacatgtggtgtttggtttttttgttcctgtgttagtttgctgagaatgatggtttccagcttcatccatgtccctgcaaaggacatgaactcatccttttttatggttgcatagtattccatggtatatatgtgccacattttctttatccagtctatcattgatgggcatttgggttggtaccaagtttttactcttgtgaatagtgctgcagtgaacatacgtgtgcatgtgtctttatagtagaatgatttataatcctttgggtatatacccagtaatgggattgctgagtcaaatggtatttctggttctagatccttggggaatcaccacactgtcttccacaatggttgaactaatttactcccccaccaacagtgtaaaagcgtatcatcggcagcaaatactctgttgttttccttgaagtgacaggctcacttggttcagttttgagaaaatgcctgtgaaagacccatgtcttaaaaaccatagtttgcttttctttcaagtaaaaaatggtgtttcataaaaacaagctagttcagcttgcaattcaaacaatcgcacaagtgctttacctgtagacaaatactgtggttgtatttgggtgtgtggcagaaattatttatgcaaccttttaaatttcatcatataggctattgaaaggatgtgttattttttaattttaattttttttttttggagatagagtcttgctctctcgcctaggctgcagtgtagtggtgtgatctcggctcactgcaacctctgcctcctgagtccaagcgattctcctgcctcaggctcccgagtagctgggactacaggcatgcactaccacgcctggctaatttttgtattttttagtagagatggggtttcaccatttggtcagactggtcttgaactcctgacctcaagtgatccgccctcctcggcctcccaaactgctgggattacaggcgtgagccaccatgcgagccaaaaggatgtgttcttaaaaaaagacatgcttgcccaggcacagtggctcattcctgtaattccagcagtttgggaggccgaggtgggcagatcacttgtggtcaggagttcgagactggcctggccaacatggtgaaactccatctctacttaaaatacaaaaattagccaggcatggtcgtgcacacctgtaatcccagctactcaggatgctgaggcaggaggattgtttgagcctgagaggtggaggctgcagtgagccaagatagtgccactgcactccagcctgggagacagagcaagactctgtctcaaaacaaacaaacaaacaaaaaaaaccagcaacaacaaaaaaaccccaaaacaacatgttcttagggttcaggatttaacaaaattaacaatttttaagtaacttttttactgtggtaaaaaaaaacacctaacatgaaatctaccttcttagcaaattttaagtgagcagtacaatattgtcaactataagtacaatgttagcagatcttctcctgatctttttcatcttctatgagctgaactttatatccattatacaccaactccccattttccccttcctgcagcctctgacaaccaccattctactttttgcttctgagtttgactacattagatactttatataagtagaatcatacagtatttgtcctgtggctgtcttcttaccttagcacactgtccttaaggttcatccacattgtagcacatgacaggatttccttcttttttttatggctgaataatgtttactttcatagatatacatgacgttttctttatttgctcttctgttggtggacatttaggttgtttctacctctaggctattgtaaataatgctgcagtgaacatgggagtgcagctatctctgtgcgatcctgacttaaatttttttggataagtactcagaagtaggaatgctggatcatttggtagctctacttttcattttttgaggaatctctatactgtttttcataacaattgcattattttattttatttaatttttttcgagagataggcttttgctttgtcacccatgctggagtgcagtggtgcaatcatagctcaccgtaaccttgaactcctgggctcaagtgattctcctgcctcagcctcctaagtggctgggactatagggatgtgccaccatgacccgctaatttttaaattttttttgtagagatggagtcttgctgggttgcccaggctggtctcgaactcctagcctcaagcaattctcatgcctcggcctccaaaaagactgggattgcaggtgtgagccacatgcctggcctattttttttcttttttttgagacaaggtctcactctgttgcctaggctggagtgcatggcatgatctcagctcactgcagccttgacctcctgggctcaagtgatcctcccacctcagcctcccaagtaactgggactataggcctgcaccaccatgccgggctagttttgtctattttttgtggagatgaggtctctttgttacccaggcttattattttttatttttgtttttgagacagcattttgctttgttgcccaggctggagtgctgtagtgaaatcatagctcatcataacctgaaacccctggactcaagcaatcctcccgcttcagcctcccgagtagctaggactcacaccacaatgcctatttctttctttttttttttttgtagagacagggtcttgctatgttgttcaggctgatctccaactaacctcaaggaatcttcctgcctcggccttgcaaattgctagaattacaggcatgggccaccgtgcctggctggcatcaccattttcttttattttggaaatatgttttattttttaattttttttttttgagacagggtctcactctgttgcccaggctggagtgcagtggcgtgatgtcagcatatgttgattgtagagatggagtcttgctaggttgcccaggctggtctcaactcctagcctcaagcaattcttatccttggcctccgaaaaggctaggattgcagacctgagccaccacgcttggcaagagttcccttttatccacatcttcgatacttattttttgtctttttgataatagccattctgacaggtgtgaggtggtatctcattgtagttttaatttgcatttccctagttattaatgattttgaggtttttttttctgttggtcatttgtatgtcttttgagaaatgtctactcaagtcctttgcccattttaaaattgggttgttttcttgacttcttttttttttttttgggagacgaagtcttgctttgttgaccaggctggaatgcagtggcaccatctctgttcactgcaagctctgcctcccgggttgacgccattctcctgcctcagcctcccgagtagctgggactacaggcgcccgccaccacacccgactaattttttcgaatttttttagtagagacagggtttcaccatgttagccaggatggtctcgatttcctgacctcatgatccgcccacctcggcctcccaaagtgctgagattacaggcgtgagccaccgtgcccggccccttgacttctttatatattttggatattaaccccatatttgatgtttggcttgcaaatattttctctgaatccataggttgtctccatcacactgttaattgtttcctttcctgtgtagaaactttttttttttgagacagagtctcgctctgttgcctaggttggagtgcagtgccgcgatcttggcttactgcaatctctgcctcctggatccaagcgattctcctgcctcagcctcctgagtagctggcattacaggcatgcgccaccatgcccggataatttttgtatttttagtagagaagggtttctccatgttggtcaggcttgtcttgaacttctgacctcagattatctgcctgccttggcctcccagactgctaggattataggtatgagccactgcacccggcctcctgtgtagaaactttttttgtttgatgtaatcccatttgtctatttttgctttaattacttgagcttttggggtcaaatctaaaaaattatagcccagaccagtgttgtgtagctcttcccctattttttcttttaggatttttatagtttcaggtcttacatttaagtctttaattcattttgagttgatttttgtatatggtgtgaagtaagtgtccagtttcattgttctgtatgtggatattaagttttcccaacattctttattgaagagactgtcttttttcccattatgtgttcttggtaccctttgttgaaaattaattggctataaatgcatggattaatatctgcgctctctattctgttccattggttgatgtgtctgtttttatgccagcgccatgctcttttaattaccctagttttgtaatatacagttggctggccttatatttagtgggttggctgcatccacagattcaaccaactgcagatcaaaagctgtggatatggagggctgactgttaagtatttttctatctacagttggttgaatccgcagatgcggaacctgcggacgcagaaggatgactgtatatatgccatatataagggacttttgagcatctgtgaatttggtgtgtgtgggagatggtcctggaaccaatcccccgtggatacagagggccaactgtaccttgaagtcaaatagtgtgatactttagcttttttctttttgttcaggattgccttggctattggttttttttttttttttggttccatataaattttaggatttttctgtttctgtgaaaaatggcattggtgttttgatagagattgcattgagtctttatatctcttcgggtagcatggacatttaaacaatcttaattattctaatcaatcagcatggaatatcttttcatttatttgtcatcttcagtttctttcatcagcatttgatagcttgtggtgtatggatctttcacctccttggttaaatttattactaagtattttatttttgtagctattatatttttatttttatttttctctttttgccattcttgcaatgctacaatatagctattttaaatggaattaaaaatttttttcaggtagttcattgttagtatatagaaacactacctatttttgtgtgttgatttttatatcctgtgattttaccctatttattatttccttttttaaaaaaatttttttgccttgatggatacagtatatttattatttctaactttatggtgtagtcattaggattttctaaatataagatcattttgtcagcagagacaatttcacttcttttcttgtttggataactttcatttcttctttttgcccaattgctctggcaaggacttttagtactctgttggatagaagtggagagagtgggcaggtacctgatcttagaggaaaaactttcaacttttcactattgaatataatgttagctatgggcttgttatttatggcctttttttgtgtgtgttgaggaacattcattctatagttagtatgtattttttttttgatatggagtcttgctctgtcgcccaggctggagtgcagtggtgagatctcggctcactgcagcactgcagcctccacctcctgggtccaagcgattctcctgcctcagcttcccaagtatctgggattacagacgcacgccatcacactcggctacttttttttttttttttttttgagacagagtctcgctctgtcgcccaggctggagtgcagtggcgccattttgactcactgcaagctccgcctcccgggttcacgccattctcctggctcagcctcccgagaagctgggtctacacgcgcctgccaccacacctggctaattttgtttttgtatttttagtagagacggagattcaccgtgttagccaggatgatctcgatctccttaccttgtgattcacccgcctcggcctcccaaaatgctgggattacaggcgtgagccaccgtgcccggcccacactcagctgctttttatatttttagtagagatggggtttcaccatgttggccaggctggtctccaattcgtgacttcaagtgatccacctgccttagcctcccaaagtgctgggattacaggcgtgagccactgcgctcagcctctatagttaattgttgagagttttatcataaggatattgaattttgtcaaatgctttttcggcatctaatgagatgatcaagtgatttttatccttcattttgttagtgtaatgtgtcacatttagtgtatgttgtaccatccttgcatcccagggataaatccattgtgatcatggtgaatgatccttttaatgtgctgttaaattctgtttgctggtgtttgttgaggattttttcatctgtgtttataagaggcattgacctgtgattttcttttcttgtaatgtttttgtctggctctggtatcatggtgtagtagcctcttatattcctttttgtttctgtgtaattggttgtaatgttttctcttttgtttctaatattgtttgaattttctttttctttattgaatgtctagctaaagatttgtcagttttgttgatctttttttaaaaaaaactcttaattttattgatttttttcattttcattttcttttttttttttttttgagacaaggtctcactttgtcacccaggctggagtgcagtggtgctatcttggctcactgcagcctcaacatcctgggctcaagtgatcctcccgcctcagccccccaagtagctgggactacaggcgtgggccaccatgcctagctaagtttttgtattttttttgtagagagagggtttcaccatgttgcccaggctgatcttgaactcctgagctcaagctatctgcccgcctcagcctctcaaagtgctaggattacaagcgtgagccaccgcacctggctgatttttttttcttctttaattctctatttcagttgtttctgccctaatctttattatttccttccttctattaactttggacttagtttattcttctttttctagttccttgaagttttgagttaggtggtttgagattaaaaaagaaaaaggcatttataggcctggctccgtggctcacacctgtattcccagaactttgttgggctgaggtgggcagattgcttgagcccaggagttccaaaccagcctgggtaacatggtgaaaccccatctcttcaaaatatacaaaattagctgggcatggtggcatgcacctgtggtcccacctaatgggatgttgggggggtggtggtgctgaggctgaggtgggaggatcacttgagctcaggtcgaggctgcagtgagccaagattttgccattacagtccagcctgggtgatagaatgagatactgtgtcaaaaaaaaaaaaaaaaaagcctttattgctacaaatttcctcttttgaaccgcttttggtatatctcatgaattttggtatttatgttttcattttcatttgtctgaaggtatttcctaatttcctttttgatttcattctttgattctttggttgttcaagaatgtgtttaatttctacataattgtgaactttccagttttctttctggtattgatatctagttttattccattgtgtttggaaaagatacttggtatgatttctatcttttaaaatttgttatttgtttgtgatctaatgtgatcagaatgttagatcacatgttagagcctggaaaaaggtttgtgtgtgcttgagaagaatgtagtctccttatcttgggtggcatgttatggatatgtccattaaatccatttggtctgtagtattattcaagtcttctgtttccttactgatcttttgtctgggtattctatggaaagtagtgtatgaaattccctactattactgtgttggtgtctatttgtttcttcagctctgtgtcacatatattcatatgctgttgtcctctgatgtggtatgtgtatatatttataattgttatattttcaaagtatattttgtctaatataagcatagccacccctgttctctcttggctaacatttgaatggagtatctttatccatcctttcactttcagcctatctgtgtccttaaatttaaaacacgtttcttgtagacagcatacagctttttaaaaaaatagctcatcttaaaaaagatcaatttagatactttgtcttttgaacatggagttagatgttacatttaaggtaattactgacaggaaaggacttactattgccattttgttaattgtttttctgtgttgtagctcttctgttcctcttttcctctcttgcactcttcctttatattttattacatttttccttgcaatttgtttgtttaagagattgggtcactctctgttagattttcccacagtttggattttggtgattgtatccctatggtatctcttaatatattcctctgttgtctttttctgtaaattggtagttggatctagatggcttgatcagattttgattcacactttttttccccctaaagacaacttcataggtaggtgatgctttcttttcttttttcctttttttttttttcctgtctcccaggctggagtacagtggagcgagcagtcatggttcactgcagccccaatttcctgggctcagatgatttgattttttcaccccagcctcccgagtagctgggagtgcaagcatgagccaccatgccaggctaatttttgtattttttgttgagacagggtttcaccacgtttcccaggctggtcttgacctctgggctcaagctatctgcctgtcttggcctcccaaagtgctgggattacaggcgtaagccaccatgcccagcctacatggtgttttctttcatcagaatctggaggcacataatgtgtcatagtctttttttcttttcttttctttactttttttttttttttgtagagacagagtcttgctctgttgccaggctgcagtgcagtggcgcgatcttggctcactgcaacctctgcctcctgggttcaagcaattctcttgcctcagcctccctagtagctgggactacacgtgcatgccgccacgcctgactaatttcttttgtattttagtaaagacggggtttcattgtgttgcccaagctggtctcgaactcctgagctcaggcaatcctcccgccttggccttccaaagtgctaggattacaggcgtgagccactgcgcccagcccatagtctcttttagtaatatgagcagccattggtagatgcctagattcttttattaattaggggtcttaaatggtgatattctaatttcataattccttctttattactacagaggtatttttaatcttctatgagttaccagtggtacagtttgtatatgaaaggcagaataaatgcttgattaaatttttttttacttgccagttgatataatttgctttataagaatcatctcatgttagggtggaaattgaaatacatgttttctattttattctagtttgcatttatgtcggatcctcagtgaaaataaaagccatgatagttcaacatacagaggtaagatttttaaaagtatcttagttatttcttgattaaaattagtaactgtctgctttctattcattgttaggtatgaaaacaaaaggtgtaagatagttcacattatataaaggttttacatggttatattatagtcaggattaaaactgcagttacagtaagactatatctctgtatactgatgttatttgacctgcattataatgatatgatattgcttgacttttgtaattggggcttggtatatttagctaaatttcagcagttgttagctgtatcaatcataaatatgacagaaaagataacatggaaagaaaaattgttctgatcttatttgcactagaaaatttccagaaactgaggttcagtgtttttactaaagctggttatgtttaggtggtgtctagggatcttgttaaaggcagttgtcatgggaaacattcaaaggagttgtttactgcatatcacagatatgatttattaaatgaaatatgtaattaagcagtatgtattataattttccagtaactttagtttcaaaggattttactatttaacattttgttaatttaaaattagacatgtggatttggcaaaggaggggcaaagctaaaagtgattgtgtctagtaagtgtaaagcatttacagtagtattgttgggggtaaaacccacattatttttttaaattagaaaatacatttttataaccgatattctatttgaagccaaaaatcattagataaaatttattatggtcatttaaattatgcttttgtgaaaagaagattaagaacaattttacatatatatatatttatttttgttctaccaaaaatcatgactttcataatagaggatatacttttttttttttttttttttttttaaagtagacagggtctctttccattgcccaggctgtaatgcagtggtggtgtaatcatagctcactgcggcttcaaactcctgggctcaagcaatcctgccacttcagattcccaagtagctgggactgcaagtgtgcaacactgctccttgcttatttatttatttatttatttgagatggagtttcactcttgttgcccaggctggagtgcattggtgcaatctcagctcactgtaacctctgcctcccgggttcaaacgattctcctgcctcagcttcccaagtagctgggattacaggcatgtgacaccatgcctggctaattttgtatttttagtagagacggggtttcaccatgttggtcaggctggtcttgaactcctgacctcaggtgatctgcctgccttggcctcccaaagtgctggtattacaggtgtgagccactgtgcccagccttatttttttaatttattttttgtagagatgaggtgtcttgctatattgcctaggctggtctcatattcttgacctcaagcagtcctttcgcctcaggctcccaaattgttgggattactgtcatgagccaccttgcatagctgaggatatactttttaaagaacatttgggccaggtgcggtggctcacgcctgtaatcctagcactttcggaggctgaggtgggtggatcacttgaggtctggagttcgagaccagcctggctaatatggtgaaactccatctctaccaaaaaaaaaacaaaaacaaaaaaaaattagctgcgtgtggtggcgtgtgcctataatcccagctactcaggaggctgaggtacgagaatcgcttgaacccgggaggcagaggctgtagtgagccaagatcacaccactgcactccagcctgggtgacagagtgaaccttgtttcataaaaagaacatttgggtgtgtgagtggaagatggttttttttttttgagatggaatctcgctctgtcacccaggctggagtgcaatggcgcgatcttggctcacagcaacctctgtctcccaggttcaagcgattctcctgcctcagcctcccgagtagctaggattacaggcgcccgccaccacgcccggcgaacttttgtatttttagtagagacggggtttcaccatgttggccaggctgatatcgaactcctgacctcaggcgattcgcacaccttagcctcccaaagagctgggattacaggcgtgagccaccgtgcccgaccgaaaatgtttttttaacaaatgaaaaagccatttttcaccctgtcatatgggtaagacctgttttaagagttaacattcctagcctgccaccccccaaattattttcttgtttatcctgcttataaaattgcatgatcactcaaaagatttttgaggttgatagacagtaatgtattcttgtttaagttagttgactgtcagaagtataagaatgtacaaaaagactcctttctaaaaatacttgggtactttatcttttttcttccccgggtttaaaatcagtttttaacatctcagttaactttgatcttgtttgatagaaacattaggtggataaaatagaagaattttcaataaatgatagtgtaaatagtgtaaccatgtgactctggatctttaataactattagattattgtttatttgcatggttctgattcacatgtgaaaccagaaatagttatgagtgtggccttattggctgaattgccattgctctccttctcttacccttgcctgcttccttaacacatatactccttggctgatctctgtcaacaggcaggcgttggtttgaggggctccagtttgttgtcctagcaggaaactgactgaatgtcatttcttcagaatctcttttctgtcttaggggtttgagttcgggcagtgtcccctctgacctttctctttctgcccttcccttgaattaatttcatttcaggcaggcagtttcccttgcacacactgcttttccttgtttcttttataaatcaccttcccccccaccccagccactgccaatgaaacaacattgtaatgatggctaataaacatgagtaattggggtacagtgtgatattttgatacgtgtatataatgtgtaatgatcaaattagtgtagttagtgtatcacctcaaacatttatcatttctttgtgttgggaaaattaaaaattccttctagctatttgaaaataaacagtacattattgtttaaaaaaacaaacatgagtagtactagcaatattagacataaccaagaactggtgtcttcaacattcaaaccccgcaaaaactaagaatctctagaagtaccttctcggggccttttttttgagacagagtctcccgctctatcgcccaggctggagtgcagtggcgccatcttggctcactgcaagctccgcctcctgggttcatgccattctcctgcctcaacctcctgagtagccgggactacaggcgcccgccaccacgcccggctaattttttgtatttttagtagagacggggtttcaccatgttagccaggatggtctcggtctccttaccttgtgatccgcccgcctcagcctcccaaagtgctgggattacaggcttgagccaccgcgcccggcctctagtggctattcttaaaactactctttctgaagtgttaacattaagataaaatattttattgaatttttttgtagataactataaggttgtaagttttcctcctcattgtaaatataaagtttttcacctgcaatatagattttataggtttctgtggaactagcctgacagttttaaaccaccacttacagttctatggataaaacacaataggagttcctaaccatttttaaataggcatttagaaaactcgtgaattaggctgggcctggtggctcacgcctataatcccagcactttgggaggccaaagcgggtggatcacttgaggtcaggagttcaagaccagccgggtcaacatggtgaaaccctgtctctaccaaaaatataaaaattagctgggcgtggtggcggacacctgtaattgcagtcacctgggagactgaggctggagaagcgcttgaacccaggaggcagaggttgcagtgagccaagattgcgccactgtaccccagcctggagggcgagactctgtttcaaaagaaaaaaaaaataagaaaacttgtgatttagggactattcgttgctgctgtgtggattacaatgtgattgttcttatgtcactttagtttcagcaaaatgacccaggtcacttgttctctattttaatctccttctgtggttaagattagacttccctggtcccctatgagtaccagaggacatattctcatgggaccttagtttttgataattggctattttgttcttctaagttactgctttaaaaaaaaaaagccaaaaaaaccaccttaattgtctggaaaattttaaataagtattatttgttgtttgttgtaaagcattttattcatggaaatacaaagcataaagttgacctcttatacctgcgataccaaaatacagaaattttttcctttgtttttatattgttatttaaaagcacaacgtagatatagttgtaaaataggcagaatatatttaataaagaattcttcataaataattggaataattattagcaatagcaaatagcaatagcaaatgatttaatgaacaagttaattttactgcaaaatagtattttcattaaggggggatttatgtacattttgatttctattatgttcctttttgtggctaggagtcatagcaggggagaagtttatttttatttttatttttattttttgagacaatggtgctatcacaactcattgcaactttgatctcctgggcttaagttcccgcctcagcctcctgagtacctggcataacaggtgtgtgccaccacatctggctaatttttttttttttttttagtagagatgaggtctccctatgttgcccaggctggtttcgaactcctaggctcaagccgtcctcctgtcttggccccacaaagtgttgggattttaggtgtgagccactgcgcctggctaagaagatttttaaaatatttgattttttaacttgctgtttggttctgaaaaaattttgattccactcaaaaggagattataaatagactttattttacattagcatctttaaagcttcttgtttcactacttttcatgattggaaggaggtaaagttttcagtatatgggacttaaaaaaaagatgaccagaaggaggtgttcacctgaccactaactacccactccaaaaccaaaatatcttttttcaggaaaggggactgtggtaattaatagtgaatgttgctacttgtagttgacagttatcatagaactgccattttatacatgtattttttgtttgatttttatgggacaaagagatttagatttggggagaaatttctctcacactagggtatggttaaaactcggtagtatatgtactgctattctttatctgttgtcactatagtgctgagattgaattgagtatatatctgaagtctactggtgaggagaatgattggtttgaatccacttgctagagttcattgaatataattatagagacttgagtagcatgaaaaaatgctttaaaattgttttggggggaatcagaatgctatatgatgtgcatggtgaatttaaatatgtaaaatctgtagacatacagaaaaaactggaaaggaatgttcaagctgtagttatagtagtggagagatggttaacatttttctaaccttttaattttgtgtttttgtgaaaataaaagaaaaaattgctagaggaaaagcattagaattatatttttcattattgatgtttataataattctgagacgtaggaaatatatagatttacttttcatgttcaagagactgtatccttacattatttctcttatgttcaacagatttccagcaagctctctatgagttgtcatatcatgtaattaaaggaaatctaaagcatgaacaggcatctaatgttcttagtgacattagtgtaagtatgtatatatttttttaagttaatagttgttatatatctttttgctttgacacaaagatccctgaagtttataacttgtattttattcaaaattatagaagtggatggatttttaaaattttatttttttaacttttttcccctcagaactatggaagtgagtaatggatgttttaaggtgacattggtaacccatttttgccagacaggaacacagatagtttaatatttttatctggttgttggtaaagtaggaaatatcaggtaagctggtagggagaaaaaaaaaagcctgtgctgtaatgaaattaaggtatccatgggtgggggaggggggagggataacattaggagatatacctaatgtaaatgatgagttaatgggtgcagcacaccaacacagcacctgtatacatatgtaacaaacctgcacgttgtgcacatgtaccctagaacttaaagtataattaaaaaaaaagaagaaattaaggtgtccttaataaaaaatgccactctaaaaaagtaaattggctaaaatatttttctctcaatatagtataagccattttttgtttgtagttatgtttagaaattaaatatattttaaaaattgaggattaaattattttaaattgcaattgtttggctctaacattcacttggtgctagttttcatttacttatggtttaaaaaatatcgactagattaaaaaaaactcttttacatggttattctgtttcactccttcatttattggagaatttaagttagattcagaccaactatttttcatggtggtttgccatttaaattggaaaatgggctttcaaattgtaaaccagtagttaagcttgaggttttacaagtggcgtgctgttcttttattattaagctggcttttaaacttgtatataaataaaattatcttgtgtctgtgtatatatgtgtatatatacatttataatgaacttgtatatacataaaattcagaatagcttttataataggttttattaaggtgtgggatttgaagcttcttggtctcaatctgaacttctcttactgtgtttctttaatcttctgtagcctttttttctgtcaggggaggtaatatttgtatgttttttgtgctttcccagggatagtcttaaggaaattctaagtttagctgttgtgattttccaccccatattggggtgtatttgagcagtaggaattctgtgagtttcccttttgtctctaaattatctccagctgataacaacagaattagttcatgttggagtagtcaaattcctttttttttaacgttaaaaaaattcagttgctaccaatctttcttaaacaactaatatttcatttttgaaaactcttgtcttactctatttttgatcttcaagtggcctgagtacttgcatttaaatagacataaccagagttcagagcccttaagaaatttgaggctaaaatctgattgacaaggttatttcattttgtaaattgagcattggtataggttttagtttgtttatgggatctgattctgattcttttttcatttattgaaaatggatagttcaagtgaattttatatatgtgtgtttggttcttacatagcttcttctttcttttgaatacttaatgatgtctttatagatacttctgcagcttgattgtctttgtcatggctttctcttagtactatatactgtccagtatcttacccacagaagagtaacttgtgcgtctccttgcagctgccagatttttctttagaatttcttttagtttctgaaaataggctaattttagggttgctatactgccagccaactgttaactgcagtaagtgaactatgatcccttctaatggaaaatagccctaaaattgagcgtgggagtggaaagtcaagagacaagtctagaataatgctgaagtttttattcagaaacaggaggatccttttcttttcttttcttttcttttttctccaagacagtgtcttgctctgttacccaggctagagtgcagtggcacaatcttggctcactacaacctctgtctcccagattcaaacaattctcctgcctcagcctcccgagtagctgggattacaggcgcatgccaccacacccggctaatttttatattcttagtagagacagggtttcatcatgttggccaggctggtcttgaactcttgaccttgtgatccacctgcctcggcctcccaaagtgctaggattacaggcgtgagccactgtgcctggcccgattttgggtcattttctccaaaggctacaagagtaaataaagaaaataaagagaatattgagctccaaaaaagcggggagggaggagggcaataagggttgaaaaactacctattgagtactgtgttcactatttggatgatggattcgatagaaacccaaaccccagcattaccaaatatattcatgtaacaaacctgtacatgtacctcctgaaactgaaaactgcccaaaccagcttttagctttttagctggttttgtattttcaagatttctgtttttctgataccattatgatttttgcataaatcaaatattgactcaggcatgagcacaacatttaaagtcttggatgaaaaatgtacagtttttaacagtcttcctttaggtaagtatgaggcactctaaattcacgtgatttctaaaacgaaacttctttggaaaaatgttactcatttgtgctctttatttcctaaagtgcttgtttaggtttctgtttttttatcaagttattttatggtagacatttaaacattttttgcaaacattatcttcttcctctttgttatgaaagtttacttgaagaattttaatatttgtcaatataatgatggggtttttgttttttaaaaatcttttttcagcaccacctggaaatcaatttttttttttttttttttttttaaagacagagtttcctctgttgcccagggtggagtgcagtggtgcgatcttggctcactgcagcttccacctcccgggctcaaatgatcctcccacctcagcctcctgagtagctagtacaccatcacgcctggctaatttttttttttttttttttttttttttggtagagatggggtttcaccacatggtccaggctggtcccaaacttttgggctcaagtcatctgccctcctcggcctcccaaagtgctgggattacaggtgtgagccactgctcccagccattttttgtttttaagtttcacagaagagtgttattatgaaaccctaatacttgctgtgtgcttttttgctatttattgtaattatatttttaaaattaggaatttcgtgaggatatgccctccattcttgctgatgtattctgcatattaggtaggtattaagcctttatttcacctgtaatgtgctgtgtggtaaatcaaatgtttgttaaataaaatgttttaaactaagaattttacaaatgtttctgcaagtctagaagcaaattgattctttgtagagaatatagcaatataagtcaaatgtcataatcaatgttataaacaaactttagaggtataattcaaattgtttgagtttttgacaatgtagatttctataaatttgagctaaattaagtcatttcaagttaaaaggccaagttttctgagattttggtaaccaaataatcttattcaatgcaggttttcaatgaatgatgtcagaatctcagacttaggactctcaagaaatacttactttgctcttgtactcttttgattcttaattttagaaagagcaagaagagccaaagtaatcaaaagtacttttgttttgaggatgagaaaccagctttgggaatagcaacttctttatttttccagaataaataagggttcatgcaagataaaaaaaggagtatttctgtgacttagaatgaaatgtagtatccgatggcatggatttaaacaataatgtttattataatttttttctctaattttagatctagatgaaaataactgagcacagttttcccttcagtcagtcctgtgctttcttttcttttcttctcttttttgagacatggtcttactctttcgaccaggctggactgcagtggtgtgatcttggctcactgcagcctcaacctcgtgggctcaagtgatcctcctatctcaccgccatgccctgctaaaatatatatatacatataaaatatatgtatatacacatatatattatatatacagatatatataatatatatgtgtataatatatatgtatatatgttatatatgtatgtatgtaatatatattatatatatgtatatatgtattttatatatatctgtatatatatattggtagagatggggtttcaccatgttgtccaggcttgtctggaactcctgggctcaaacgatctgcccacctgagacttctaaagtgctgggattataggcatgagccactgcactaggcccagtcttgtgctttctgtaactttgaatctaatagaagacattgccaaacattattatattcattttatttatttagttagtttttagaggcagagtctcgctatgttgcccaggctggtcttgaatgcctggcttcaagtgatgctcccaccttggccttccaaaatgctgggattataggtgtgagccaccgcacccggccaatattcactttaaaataagacatcctctgcaggtttgtgaacctggaatgaattgttttagctcattaatcttaattcttagaattagataaattacttaaatatcttactgagaatttagaatttgttcttgacaaatataaatcctggtgcttgatccttcaggaagtttcagatttcctaagttcccggtaatgttgggagtaggtcaaaatgtatgtggactgggagtgataaatgaaaagagaagaccattgatgagatgaccacatgtcccagttttgttttgttttcactggctaattattaatagtaccctcttttattctcataactatcctggtttggatgatagagtatatgttcatggtatctgttggattgatgtaagccaaccaaaaaatgttttaagctaaaatttttagtgaggcactaaagatattacctttttttttttttgcaaataaatacatcatgaaacaaatttcagttaaaaatatttttactataaatttgtaagactgtaagactgatgtgtaggtaacattttgtggaagctattgttccttgatagtgtcaggagtatatctttctttgggtaatcatcaattatcagcttattggccctagtaatttctttattgacttactagattatatttttcccttcatagttatttagtaatatgaattattgttacaagtcattgtcttgtacgagtaacatgaattcatgaagatgatgcttggttgcttttgggaaatttctcttagcctatccagtccattttttgtttgagatggcatcttgctctgttgcccagactgagtgcagtggcacgatcttggctcactgcaacctctgcttcctgggttctagtgattctcctgtctcagcctcctgagtagctgggattacaggcgcgtgccaccacgcctggctaattttttttgtatttttagtagagatggggtttcaccatgttggccaggtaggtctcaaactcctgacctcaagtgatctgtccaccttggcctcccacagtgctgggattataggcgtgagctaccgtgcccggcctatccagtccatttttataagcaagattatgacggcaaacttggaaagaggatttccctcacctgctccctcactcacctaccctcacccttggcagaaaaaaaatgattcaagtgtgatcccagatcaaggatggggaataggagtaagaatgctagctacctctaataataatgatgatgatgatgacaataataatgataacaatttaagttctgcttttagagtaccttccatgttctaggcattgtgttaagcatttaatctttgttttaatccttacatcaactcctgtaaaggtggtaggagtacagatcagaaaaatgaggttcagcgaagctgtgatttttcaaggccatgcaagccagtaaggcagaatttgaacctgggtccctttggctccacagcctatgatctttttattacatcatattgtcattctaaatgttgacagttacaagggaaattagtgctgcactttccgggttaagatagcaacttcctccccacccccccacccccccccaccccctcaccacctcccccccgccgcccccagccccgccccgagaatggagtttcagtcttgttgcccaggctggagtgcagtggtgcaatctcggcttgctgcaacctccacctcgtgggttcaagtgattctcctgcctcagcctcctgagtagctgggattacaggcatgtgccagcacgcctagctaatttttgtatttttaatagagatagggtttcgccctgttggccaggctggtctcaaactcctaacctcaggtgatccgcctgccttggcctcccaaagtgctgggattacaggcttgagctaccacgcccggctgatagcaactttaacagactaatagtatgaaggtgagggggcatgagagctatagaaagggggagtctgctgtaagttgatatgctgatggggcctctgggctggggtaggtaattggtgatgctgggcactagagctggaaatagctgagggctttttattgaaatcataggggaaattaaagagaatttattcgaggtaaaggagtcagggataataaatgagtttattagaatggtgttatgagttagagcaaaaagaataaagaaaccagggaaggtacagttgggataatagagtcctgtactgattgttgagatagctcagctaagaaatttactgagactcttttaagcgtttcctaacattgtcagaacccaagagaatggttagacatttaagtaatttatccaattctaagaattaagattaatgagctaaaataattcattccaggttcacaaaccctcagagagtaagtgtcttaatcaggttaagtggctgagaggagagacttgacttgaagaggatgaatctgccatccagtgcccctgttcttagggaccttgagaggtagatcttagggactttagggccctggagcatagatacatgttgggtaaaagaatgggcccagtttagccccaatcccttaaaatcagtatctttaaagttctagactgaggagggaccagaaaaccagatagcagggcaacaattgggagtccctgaaaaggattggtgagatacacatgggttaaaagtcttaatgagaaattgagattgtattgtaatttacattgcataaattataccctaaaatttccttaatacacatgagctaactgtgtgcttagctacagtggccaggatatgtagaaatggcaactgtccaagaagggaaagtcaagggccaggaaaatgtggatatgtttgatgaaaaatccctttctcttttgattcttagtgttggcagtagaacatgtagatgacaatttttattacttcactaaaaccagtgcttctctttatagcatattctaaattatgagttgactgtaaaattaggttaatagtatataatcagttaaagcagtaatcctgagatcagccttgtttgtaatcctgccaatgctggttgaaatttttggtgcttggcatttggcactaattgttttttttcttccacacttcagatcagaaaattttttgacaaattttctgaataatttactgaaactctcagtttttaaatatttcagtaggaagataaaaattttgaataatttctatttactgactagaattataattcaagataagatgttaattttttttttttttgagacagagtcttactctgtcacccaggctggagtgcagtggcgtgatctcggctcactgcaacttctgcctcccaggttcaagtgattctcctgcctcagcctccctagtagctgtacttacagatgtgtgccactgagcccagctgatttttgtatttttagtagagacggggtttcatcatgttgcccaggatggtcttgaacccctgacctcaggtgatccacccgcttcggcctcccaaagtgctaggattacaggtgtgagccactgtacccggccaaaaatatttaatactgtcttttcataaggttggtggccaggtagcttggttagaacatggtaatttgaccagggtggcgaaagtcatgggtttgatcttcatgagtattaggatctttttttttttttttttttgagacagagtctcgctctgttgcccaggctggagtgcagtggcacgatctcggctcactgcaagctccgcctcccgggttcaagcgattctcctgcctcagtctcctgagtagctgcaattacaggcgtgtgccaccaccccaggctaatttttgcatttttagtagagacagggtttcaccatgttggtcaggctggtcttgaactcctgacctcatgatccgcccgccttggcctcccaaagtgctgggattgcaggcgtgagccactgcgcccagcctgagtattaggctctttagagttagaagaaatctttgttataaccctgttcaactttccacctaaaataatcttttttttttttttttagcatctctgacaagtggtcatttaaactttgtttgaatgtttcattttttgcgaacaatagtttttgaagctttgttgcttccagtgccatagcaggtagctccagtgtagttgatgtactgttttatggatctgtcataggtcacagggtcaatctccagttttaggagaaattaaagcattcatataacatctcatgttaccatagttttgaatttttccaaattcagattgaggcattttaaaattagttagtttcaaataaaataagtatcttactttagtgctggggagtctagacaaatcaatcaaacttttttcttcttcatcattatagacattgagacaaattgtttagaagaaaaaagcaagagagactattttacacagttggtattagcatgtttggtaagtttttaaaaatatttttcccttttaaaaatctgcattaaacagttgtaatagaagttaatcatgttaatgaaggaggatattgacattcagttgacttttctcataaggtgagatttgggttttgaaatggaatgttttgtgaaataagacatgctgtttctgtgaaataagcatgtaaccatatccatatcacttaaactatctatacatttaaaacctttggtgatattcctgacctagtaagttcctaagaaaaaggtaagcatttataaagtaagtagaaatgattgtagacagcttttaaatggatttttttcctcataaactgttaagcaaagagtaaaagaatagaggtagtttaaaaatgataaattctagaacttgccatgattgttgtctggtaaaccatttgtgttcataaatttagaaccagggagaactgccgtggttgagacctggaagaaggtgcttgtctttgctatactagaatttaacttaaagtaggaggctattaagtgctgtattaggtgaaagtccagataagccaaatgcagtcatattgaaaatttcatctgtagttcttgtcatttataggcagtatacaacatgcatataattttatagtgaattttttgaaagccgtttattaaatatttcaatatttggagtcaatatttgttaaattgaacttctaagcctttttataaattgtaggttgttatgtagagaatgttatttttgtattcttatttaggaagctttagtttgaatatatttaacattgtggatgcaatgctaaggaataaatgacctttaatattttttaatacagtatttagtttcagacacagttctaaaggaacgcctggatccagaaacactggaatcattagggcttatcaaacaatcacagcaattcaatcaaaagtcagttaaaatcaagacaaaactcttgtaagtacacgtatcttatgttgcagatcaagtatctgagtatgttttttcgttcatattttgaatcctagtagcttctaaggggactttgaagattgttttttttgtttgtggttagcatgtcttgtgttttttgccttctaaaagtagcctaatattgagtcatcagtgatctttacctgtgcaaaaccattgttacttttgcccatattcaaagttaaaataatactcatgctttcatcattagcaataaaataatttatgactgtggctatactcagggtatattcttagagatggaaatggtgatatgttattgttccctgatattaacaatatccttttcttgtgttactggttttccctatgtaattaatattggggttctcatatgaatcactgttattttctactctaaaaggtacacaaagaggtaaactttcaacaactattcttaggattgttgtaggttggagataagaaaattcagtgagaatacagtactctgtgcaagcttgttaattaaaattaattttatccccttaatgatatttatctgatttcagttataagcagcaaaaattcaatttgttaagagaagagaatgaaggttatgccaagctgattgctgaattggggcaagatttatctggaagtattactagtgatttaatcttagaaaatatcaaatctttaataggtaagacatttatctgtatagtatgtgttgttaagataacaagttattttagctattggagaatatccataaagacaaaatgagtgcattccatctattttttttttcagttaaggaatgggagaggtgtttagcttttacttttaatggtttatcaataattataaaatttagcatgatatttgtgagaaatcttattgtcactataccttgtatgttaatattaggtcctgctctgtctagtctttcttttttgtggaggggatcctgagtggtaagccaacactttcaaaagagaatggatgacaaagaacaggatggactgttctgatagagtgccctacgtttctctagtatttctatttttaagtatttctcaaccattttatggaggaccaaaaagcaaacatgaaaactttaatacagtaaatcttcagtgaacttttgaaactacagatgtgtaattttgaacttgattttcaaaataactttacaagggactttgatacttattttatctttatagtagccttttaaagtaagtgcaacagctgttgtaaaagtgtaacagataggaaagttattattctccctaccctttaagtagaattcctgtagcattactgttttctttttatttgcattgagcatttggaagaagtagttgacttctgtaaaaaagatgaatgagcactagaaaaatagggtaatccagattttcctgaggtggaaagagtttttttattatttactaggtgttgtgctatcttagggaagattttgcagtacctgggtcttgagacctgccagaggagtcatattttgtgcctcactagttgtatcttaggggtgcttatcctcagcttcttggttctttctctttttttggagtttatatatgactaagaaagagggagaaggtgtcccaatccttatctccttcctctagtgctttgtgtaggaatccaattaaaactatatttactataatcacctttgttcttaccaacaagtaagtagcttttagtttattttttaaatttttgtttatttattttttaagagacggggtctcgctatgcccaggctggtcttgaactcatgggctcaagcgatctttctgccttggcctcccaaagtactgggattacaggcatgagccactgtgcccaactaaatagccttttgtttaaatttactcttttctttgaagttaatctagttctggcagctgatctagtgtctttgttgtttcttccagttgtcaatttaacaccaagatgggtggccccctagggctgtgggactcttgcttaactgtgtggcagtgacccatttttaaaaaccttcccatggtggttccttagttcctttctgttctttctttctcttttttttttctttttttttttttagatggagtctcactccgtcacccaggctggagtgcagtggcgcaatcccagctcactgcaacctctgcctcccgggttcaagcagttctcctgcctcagcctcctgagtagctgggactccagccaacacacccagctaatttttgtatttttagtagagatggagttttgccatgttggccaggttggtctcaaactcatgacctcaggtgatccgcccgccttggcctcccaaagtgctgggattgcaggcttgagccactgtgcccagcccctttctgttctttctagggtaggcgccacactttcctgagtgttttttgatctagcttgagaaggttttcagtactgctttgctataagtttgtctttccttgtatcctgtcatacttacttaaggtagtattccccacataaaaattctgtgctattttttttttttaactttatatccttttttgttgacatctgtttcttctatttcttgtgagtttatacctttttattcctttgttattttgggaacatttcaaagagggatttttcttgaaggtgtgcttttatcttactagaaaatgtatactacttacttttcttgaactttactctcagggagaacaggctatgatcctgtttctgaagaacagtgtaacaggcacaactgcaagctcatgaggtatatggacagtctatgagtataaacaatttgatttattgggctaaacctatattttaacccaccaagtagcagtcaaatgtcaccttcttagtgaagccttccctgcccacccctgtcaaaactccctgctattccctgattatttttctttttttgcacatatcaccatataatatgctctgtacctcctccccctccacctgtgatgtaggctctgtgaggactggggttttgtttggtaccttatccttaatacttggtatgtaggtgataaataaatactgggtaaaaaaggaatgaatatttcctctattcttgtataatctatactgactcttagcatttttttcctgatatggagaattttagaaagttcatcttcctgtctcagtgtttatttatctctgactaggtgatttcctcctcccccaattgtctgagaaatgaacttttatttttttgagacagagtcttgctttgttgcccaggctagagtgcagtggtacaatcttggctatccgcaacctctgcctcccaggttcaaacgattctcgtgcctcagcctcccgagtagctgggattacaggcgtgcaccaccatgcccagctatttttttgtgtgtgtgtttttagtagagttggggtttcaccaagttggctgggctggtctcgaactcctggcctcaagtgatccacctgcctcagcctcccaaagtgttgggattacaggcgtgagcccccggacacggcctgaatgaaacttttcattgatgtgaaaatagaggttgaaacttcaattccaatgagtattctttcagtgttgttagcatttattggagtccctcttagtgcagacttcatccaggccttgtctcattctgtccagaacacctcactgaccagcatcctatttttcatggcctctttggatgggtttctctgtgtttattcccattgttttctgtttaggaacagtctagacaggtaatacctccttcatcagccagtgtcagaaactgatacctagtttgggcagtatacattttaggtgcacatactttcagggtacttggtctgaccaggataaatccttacttatcatcctttagttaaaaggcagttatttggctggatgcggtggctgaagcttgtaatcccagcactctgggtggccgaggtgggcagatcacctgaggtctggaatttgagaccagcctggccaacatggtaaaaccctgtctctactaaaaacacaaaaattagttgggcatggtggcacatgcctgtaatcccagctactctgaaggcttgggcaggagaatcacttgaacctaggaggtggaggttgcagtgagctgagatcgtgccactgcactccagcctgggtgacagagtgagacactgtctcaaaaaaaaaaaaaaaaaaaaaaaaaggcagttatttgctcctaaaagattctggcacatcaaaatttttatattctgctggataacttggggctgtttactgcatgcgcaagcaaggaagcagaaccattatgcatctgcatggtgattgtgatctgacactaaatttgaacaacttattaaatacgaatgaatagtgaacagtagactattgagctgccaagtcatagacaccatacaagtggccatagcttgaagatggcaaaaaaacatcttttagaaattagaggaaaggatatcacaggtggactcctttgtttgctgaactaaacggtaagaactctactcttttggatgcccttcaaaaaaaatcagagcatcatgctgtacactttaaatatatataataaaaacaagtggttgctaagtgttctttcctttcctttcttctaaatcagtggtcagcaagtgtttctataaagggtgagatagtaaatatttttcggctttgtggaccatatggtttctgttgtaactacttaattctgccattgtagtgtaaaaacagcgtaaaaacagctatagatagtacataaataaatgtgactgtgtgccaataaaatgttatttacaaaaacagaccgctaaatggatttaacccacaagccatagtttgctgattcttgctctaaatcaaaagttctgcctaacaactaatcacggagctagcttatttgagcgtagctttagagagtgaaaatggttcttcctggttttggattttagtggtccaggacctttttggcctaggctctaacccctttacctttgctcgcagaaccagagctttcttcaccaaacctcaagaccttcatttgttgcctggtgtcaaagggtatagatttggctagggaagggtagagtgagagtctttgcctcttcagtctctcaagtgaccagagtaacattaaaaacaaaataaatccttaagccaaacgatttttatttttggatagattatgggacatttcacccctttgactacatgattttgagtgtatttagtattttatctttggttcaatctgaatatagggtccattcaacttagacacatcttattgtgccacctttttcctatttctttgaaagggaagttggctgccttatttacttaaatttttacattattgaagtttcttggctatatgttagaagttttcccttcatagtatgaaaaagaagacagcaattagtgtttccaactataggggttttttgttgttgttatttattttatttttgttttgagacagggtctggctctgttgcccaagctggattgcagtggtacagtcttggctcactgcaacatctgccttttggactcaagccatcctcccacctcagcctcccaaatagctggtactacaggcacacaccaccatgcccgtctaatttttgtattttttgtagagatggggttttgccatgttgccctggcaggtctcgaactcctgagctcaagctatctacctgccttggcctcctaaattgctgggattacaggcgtgagccaccatgcctggccttgttactgttttttagatcatacttttattttgttattcattggttcttgctttgagatgtgcagtttttttgcaaatagtgtttcttagaaatagtctagcatagatttttattagcttctaaagaaactctttctacattgtagatcatttcattttgttaaaaacatgattttctttgtctcctaaggtccattctctcaggaacttgatgattgaggctataattccgttttcttgcctgaaatttataggctggacatctctcctagttatgtctgcaatattatcttggtcttttattttcctgttaagatctcaatttggcctaatttctacaacagtcattgtcagtttgatcatatttcttgcccctagttggtgtcactgtaacataactggttattttttctatctttggggaaactccagttgctttttcctgcatttcttcaaagatgtatcattcaaaaggtgtgaactcttctcaagggtagcgtaaacattttattaatcgctatagtttttcagctttattcaggcttcattgacatatagtagaatgcttatatttaaagtgtacaatttgacttttaatatatgtatacatctgtgaaaataccacaaacaagataatgcacattcctcccactacccctgaaattttctcttgcctctttgtgtttatcctccctctcttctctcttctgttttcccggagaatcacaagcacctggcacatagtgggtagttatttaatacttatttaaatgaaggagggcatctatggccattgtagatctgcagtttctttatttttccacttattctctttaaatatggtttcttgtttgttcctcaaaaggcataaaggcatatgtgtgtgtgtttgtgtgtgtgtgtgtatgtatgtatatgtaaaaatatatatgtgtgtatatatatataaattgctgtgtgtattaatgtagctggtggtagaggtagggagctaggtttgtgatctctgtaaagatcacatgattatcagtgcttgggctggacaaagctcttctaagatgtttgcatacaagactgcttatgttctactacagctgccattagggaaacattttggatattcaaacttactgattattattagagtctcactgtatatgaactagtttaactgttacttaaaacgctaagattttaaaaatgattttcagctgggcatggtggctcatgcttgcaatcccagcactttgggagggtaaggcaggaggatcacttgagactaggagtttgagaccagcctgggcaacatagtgagtccccatctctacaaaaaagttagccaggcatgttggtttgcatctgtagtcctggccaattgggaggctgagatgggaagatcacttgagcccaggagtgtgaggttgcagtgagctatgaatgcaccactacactccagcgtgggcaacagagcgagaccctgtctctaaaaataataataaatgaaaataattttctaaaccttcaattggctaccttttctatcttatggataaaattaattggacttacggcacctgagatatgtaatagaaaactcatgagccagtttttctttaatgaaagatgcaaaggtgatacctgttataagtaaaagtgcacatacctcttgtttcagattactgccttaaattgcacctagaaggaaagtgggtagttgatagtaaaggtcactgatagaatagccttgatgaagtaatgctgttaaataaaacataatgctagtggttcacatttcagcatactgaaaatgtaaacttaaaagcaatgtgaatgaagcacttaaaagattttaatctaacatgttgctgttctattctttatttatgagttttgtgtatgtagcctaatgggtaattataagccagccagtttgccaaaaattatattcagtgtctcttttgtcttctgtgatagagtgttaattcatttttatttagtgatttaattttttatatttagttaatgtaggagaagttacatgatttgataatttgctagatcttacttccataatctatcatcagtgttacagcagtgtgaaggcatttttcatctttgttgaggcttccttgacatacagtaaaatgcacatatttaagatgtgcaatttgagttttaacatatgtatacatctgtgaaaacaccacaaacaagatagtgcacatttctcccattccccctcaatttgcttcttcttgactcactgcagcctctgcctccctggctcaagtaatccttccgcctcagcctcctgagtagctgggactacaggcatgtgccaccatgcctggctaattttttgtagtgacagggttttgccatgttgctgaggctggtctcaaacatctggactcaagtgatctacctgccttgaccttccaaaatgctgagattacaggtgtgagctgccacgcccggcctgatctgctttttgttactgtagattaatttgctttttctagaatttgtctataaatggaatcgtacagtgtgtactgtttttgtctggcttatttcattcagcataattattttgtgattctttcatactgttacctgtatcagtagttcttccctttttattgctgagtatgtccactgtacttttccttactccacttatcctatacggcaaattgcttatccatttatatgttgatggacatttgaggagtattgtatattacagataaacctgccgtgaacatttgtgtacaaatctttgtattgacatagacatttatttctcttgggtaaatacctaggctgggtcatatggtaggtataagtttaaattttaaagaaacttgccaattttacaaagtggttgtaccattttacattgccatcagcagcatttaaggatcttaattgctattttcgaatcacttttatattcataggccatacttttttgaagtacagggggaggtaaaaatatttagaagttttcttcctagaacttcagggaaacgtctttttggagagtttatgaaaatatggagctttttttgagtaagacatgatcactgctttagtccttcttttccttagtttgagaagcggaagaaaatgtgttcttaagtttggatctcataaaaagagggaaaacttgtatttggaggatttggttttctaagtgattgctaaggtagtatgaaacgtgaaatgacattagttttgtagcatttaatataaataagtgtggcgttaatataagtaactggagatatcatcttaccaaagggttgggacatacaacctatggaaattacataggaattttcttgggaaaatcccctaactcatccataaggtataagtgtttagatgtaacatatgtccctaaatttatcacagttcttttttcctccagtattagaagaaatcagtgtttatttgttagcccaatgaagtggttagcttgcatttagggactatgtttaatgaaatatacatattttaaaatactagaatctcattcagcttgatgaaaggcatgtgggaactgacgtaaaccaggagcctccaactcccttggtattctttgatctgttaggataaatagcataccacttttccctttagaatgctactaaaagccatggatataaatcagtggtatattttatagttctgtagtatatgtaagataaaataaaaatgatttttaaaatgatggtccacttttgtgaacccggacttttaactgtttatcagcattccaaatacttctgcctaaaacattaaaaaaaaaccccttttgttgcttaatttgtaaaatgcattgtttgattttcgtgtttttccaagaattaataatgtggacctgtttcactagcccgagtaatcaagaactgatgaggcaaagtgtggcatagaggaatgtttatttgactggtatcactggtcctggactatactgacccagctctgtcattaacccgttctgtgattctgggaaagtcacattctcatctgtaaaaatgtgtagtggatttatttccctctgggagagaggaagcaaatttgtaaagaaagttgtttttaaaaacatttttatcttgctatatgagttattcctgaaaattaatggcttcactagaaatgatgtataatcatttttaaatttttgtatgtctcatctgttgcaggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggtaaagaaaaacgtgtatgtatgtatatttagagattgatttcttaatcttgtttatataatttaatttgttttatttgtaaatgattggtctcatctcaggtgttctagcagaagagatagataaatggatagctaacaatgcaatgtgataagtactatattggtagtatgaatgatgtgatgtgaaagcctagaggaaagaattattaagttttgccttgggagaggtggagtcagggaagactttatagatgtgtctttttttaaacctggtccttgaaggatgaataggagttcattaaggttttctctgcatgagtaacgaacaatgtgagaatcaagatgtggcagtgtgaatatatagagatagaaggaatggttcatagtctgatgtggctgggttgtaagatgggaaaagaagggacaggaaatgaaattgggaaggtatgtgtacttcagattgtcacaggctttgaatactgtgttaagagttagaatcttatttttatttatttattttttattttgagatgggatctcacccagactagtctcagactcctggtccgaagtgaacctcccacctcagcctcccaagtagctgggactacagtcgtgtgccactgtgcttggatcacgaattttgttttataaacaatggctattggaattttttagggatgtgaataaatattcaaggcacatcttacatcattcccttaagccactaaaatagcggtcaagctaatctgtgtctctgattatttctacttcaatccatctttcatattattgttattgttgctttcttaaagagacctaactgaggcacttcactggtcaaaaacctttacttctaggatgaaattcaaacttctaaatgtggcagaaatagcacttcacaatttggcactgttctttccggccttatctttatagttatttttttcttaaatctaatattctagtcatattaagtgactagccatttcttgaacttagatatagatattgctatgaacctttgttcctgtagttccttataactaagaaaccattcttacccaaccctctcacttctcctttcttcatcttgtgaactcctatttattctttaagagcaaatgctgcttgttctgtaaaggcttagctgactctttacccatgcagaattagtcacttcttaatctgtattctcataaaacttgacacataacttctaacacccatcagattatcttagaataaactgtatctatctcctttgccagactgtaaaccatatagggcaggtgaataaactgtatctatctcctttgccagattgtaaaccatatagggaaggttctatgttttactaattcctatggattaatttattgcctagcctatagtaaatgctcactaattgtaaacgagtgatctatgttttaggaagacaattctcttgatagcatggaggattttaatgtaataaggcctccatttaccttttggtatagctctgctaatttgtttacttgcctgggatagtcagctagtcagaaagcattcattgaatgtttatgattatgctgtttgctaggcactgaggttactctggtgtagaggagtgtctgtttctatactcttggagtgtgaggtcaggataataagataattccttttagtattcttaaatgatatagtacctactgcctttgctcatcttgtattttctatgatctgggatgctccagcagacagaagagaaagcagacgacagtttaaaagcatatagcttttcaataccaaacaagagacatggtagggtttttgggcaggagcataatacctttgttcaaaaatgagcagtggcggctgggtgcagtggctcacgcctgtaatcccagcactttgggaggctgaggcgggcagatcacctgaggtcaggagtttgagaccagcctggccaacatggcgaaaccctgcctctgctaaaaatacaaaaaaaaattagccaggcgtggtggcgggcacctgtaatccccactactcgggaggctgagtcaggagaatctcttgaacctgggaggtggaggttgctgtgagccgagatcatgccactgcactccagcctaggcaataagagtaaaactccgtctcagaaagtccactcttggtattgggaaagagagattcaagcattctgtcagattttaagagccaccatgattgctctgggcttgagtacatgaagccaactgctttagtgacaggttggctgaaatttaacttgtgcatgattaattaaaatttaaattagggctttggagactgtgggtttgagagcatatgacagtgaataatgatgacctgcataacatcaggttagttgaatgtgagttttagaatgaaaatctttttgtatgaaaacattccttataaataatgtaacttttctgagctgaattaaaatatacccgggggggtcaacagtatttgaataatctttttttttttgtagacaacgaccatttttcttatataagaaatacttacccaataaatacttaatttagaaataacttgttcttggaatgactaaccctcatattgctctatgtaataccatccctttgtttctattgttagaactgtcttatgggccaggcgtggtagcttacacctgtaattccagcatttttggagggcgaggcaggtgggtcacctgaggttgggagtttgagagcagcctgaacaacgtggaaaaaccttgtctctactaaaaatacaaaattagccgggtgtggtggcgcatgcctgtaatcccagctactcgggaggctgaggcaggagaattgcttgaacccaggaggtgtggaggtagcggtgagccgagatcatgccattgcactccagcctgggcaacaagagcgaaactctgtctcaaaaaaaaaaaaaaagtcttgtcattgtgagaatctgcagttttaagggccactgagggtaggggaagaaatgtcagatatttttgaaaagttttggccttgaaggtaaagtaaggaaagctatgaaaatcaggaactgcttaggtgatgtaaccttgagagttggctcccaagcatatatggtcaatctgtgtattggtccctggcctaattcccccatacccctttcccatcactacctgaaaatgttcacaatccttttccccaactcatatgttgaccagctgggtcttatttggattaataggcttctttttttttccccttaatgctagtattattctatgatatcaacgacagtgagaggttgagcatcccaaatccacaaagctccgaaatccaaaactttttgagcactgaatgatgttcaaaggagatgattggagcattttggattttgggttttcagatttgggatgctcaaccagtatgcaaatattccaaaatctgaaaaaaaattccaaaatctaaaacacttctggtcccaggcattttagatgagggatactcaacttgtacagtagaggatttggggacagcatgagagacagcacaaaggacaggaagggagtacaagaaagtgtgaaggtaccagaagacaaacttgtctggagttgtcttgttacaggaaaggaagaggaggtgataggtctcatccatattgccctttgatttctggattcaaaacacagtaatagtagtaatggtagtaccatggttcaaccctattatacataccccaaattcattcatttaagaaatatagattgagaatctatatttgtgcaaggtagtgtactaggtactgaggctatatctgtaaacagaaattcttacttttttgatgtttagattctgagtaaattatatgttagaaaacaattaatgagatggggaaaaatacagagcaagataagatcaggagtggtaggttgcaattttaactggaatagtgagaatactcattgaaaagttgagatttaagcaaagacatgaaggatatgaggatgtaaactgtatagatgtctgaggaagagcctctaggccaagggaacagtcaatgcaatggctctaaggtgtgagcatgcctgatgtgttgaagaacagtaaggaggtcagtgtggatgtatcagagtgattgagtagaacagtaggagatgaggtcagagatgtgggggatgagatcacagagccagtgcaaggtttttgattttgatactgagtgaagtcagtggagggttttgagtagggtagtgatgtgatctaacttagctttacattttgtttctctctcattttattgtgaacattttcaaatgtagaaaagagtgaatagtataatgaatacttataaccccattacttacaattaagtttattaacatgttgccatattaaaaatattaatttatgttacaaatatcatgaaagcttcttcctaaatactatagtttacggtttttaaaaggaagggcattttccttttttttctttttttgaatggagtttcactcctgttgcccaggctggagcgcatggcgcaatctcggctcatcgcaacctctgcctcctgggtttaagcgattctcctgcctcagcctcctgagtagctgggattacaggtggctgccaccacgcctgtctaattttgtatttttagtagaggtggggtttctccatgttggtcaggctggtcccgaattcccgacctcaggtgatcctccaggatcaatttcataacataattagattactgtcatataataaacctagactgtattcatattttccaaattgtccccaaaatgcattttacacctggtatgttcacatgatgatctaatcaaagaccacatgttgtatttgattgtcaagattcttcgtctcttttaatttagaatagttccccaccttctccattttttaatggcgttgacttattgatgagaccattcctagaagacctcatcttttggatttatctaattgctttttcatcttatttgttctttatttcctgtatttgttctatacttggagttaggtctaaaggcaaaatatttaatggcaaaaatacttcatagattatgtaacatctaatgttcgactgtctttaaatggttcagtaagtttgtgatagtctgattcctcagttatacaatggcatccccccacccccccaccacctttcccttcaataacaaattatctgcaggttgatactttggcagcctgggaatatccagtttctcatcaactttacattaaatggtttagaatccatggatgacctttgcttgagccacctttccctttaggggttccaaattgatgatttactaattttatcatgccctatatatttattagctgtcattcttctaataaagaagagttgtcccttactaactcaggctgtttgctttccttgaaatacggttcctactggaaaggcaggacaaatgattaatattttcccactaattacgagctatcagagtaaggagtttctttaatagcagcctccaatggtgacgtgagttgggtgtgtacatgtgtgtctgtggtgagagagagagagagagagagaatgcatgtgtgtgtgtggttacttagattttcaatggatcagtctgattgtgtgtggcagcagtggatattgatgagattctgaatgtatttgaaggtaaaccaatagtgtttgctgatggattggatacaggatgtgagaaagtagagttaaggactattctgaagttttttggactgagcagttaaaaagatagtgttgtcaccaacttagggaaaatttcaggtagattgggtttggagtgttgggagggagaattaggaattcactttgcgcatgttaagtttgagatgtctcttagacatccaagtgtagataatcgacatatggatctgaaggggtgggttgcccctccgcacctgtgggtgtttttcgttaggtggaacgagagacttggaaaaggaagagacacagagacaaagtatagagaaagaaaaaaagggggcccaggggaccggcgttcagcatacggaggatccatgccggcctctgagttcccttagtatttattgatcattattgggtgtttctcggagagggggatgtggcgggatcataggataatagtggagagaaggtcagcaggtaaacacgtgaacaaaggtctctgcatcataaacaaggtaaagaattaagtattgtgctttggatatgtatacacataaacatctcaatgccttaaagagcagtattgccacccgcatgtcccacctccagccctaaggcggttttcccctatctcagtagatggaatatatgatcgggttttacaccgagacattccattgcccagggaggagcaggagacagatgccttcctcttgtctcaactgcaacgaggcgttccttcctcttttactaatgctcttcagcacagaccctttacgggtgtcggactgggggacggtcaggtctttcccttcccacgaggccatatctcaggctatcacgtggagagaaaccttggacaatacctggctttcctaggcaggggtccctgcagccttccgcagtgttttgtgtgcagtggtttgtgtccctgggtacttgagattagggagtggtgatgactcttaacaagcatgctgccttcaagcatttgtttaacaaagcacaccttgcacagcccttaatccatttaaccctgagttgacacagcacatgtttcagggagcacagggttgggggtagggttacagattaacagcatctcaaggcagaagaatttttcttagtacagaacaaaatggagcctcctatgtctacttctttctacacagacgcagtaacaatctgatctctctttcttttccccacatggatctgagtaaataattggatatacggacctggtgttcaagagaatagaccaggccagaaatagaagtgtgggcatcaaaagcatgtagatgctatataaatacatgacattggatgaaatcactaagggttgtatacagagaggcaagagaagagaaccaaggactaaggcttggggcactccagtgttaagggtctaggagaagacgaggaaccagcaaataaggtagatgaggaacaacatgtaaagtaggaggaaaagagagaatgtggcattttggaagctaaatagaggaaggaatgattaaccatcaaatgcctctgataggtcatttaaggactgaaaattaaccattggagggaggtcaaaactagcagttttggtggaattgggtgatattaagagataatggaaagagtagaattggagacagtgacaattgacaactttatcaagcagttgctacaaaggggtgcagaccaaatgggatggtagatggcaagggaagtgggttcgagatttttttaagatgggagagagaacgcatttgtattctgatgggtatgactgagtggaaagtggagagctggtgttacaggggagagaggtgagaattatttggagcggtgttcttgaggatagagaaaatggagtttggtgcttaaatgggtggattaacttgatataggaggatagagagtttatcataacaggtataaaggcaatatatgtagatatagttgggtaggtgtgattgggagtttgtagaagtctaattgatctaattttcttactgaagtagaaagcaaggacatcagctgagaggatgagagagggaggtattggaggttaggagagaaggtagggaagtacagttatgtgctgcacaatgatgtttcggtcaacaatggaccacatatatgacggtggttgcataagattataatgaaacaggaacacgtagctgaagaagaggcccaagaaaaggaaactacaggagaagaacccccaagaaaattcacagtaaagggtttagcagaagcttttcagcaagctccttaaaaagttgaaaacgtgggccaggcacggtagctcacgcctgtaataccagcactttgggaagccgaggtgggtggatcacttgaggtcaggagttcgagaccagcctggccaacatggagaaaccctgtctctacccaaaaacggaaaaattagctgggcttggtggtgcagacctgtaatcctggctactagggtggctgaggcaggagaatcacttgaacgcgagaggtggagattgcagtgagccgagatcgtgccactgcactgcagcctgggtgacagagcaagactccatctcaaaaaaaaaaaaaaaagtttgaaaacatggaccccaatgctgaccaaggtttttattaatagagaggaatgtacatggcgcattgtctgcttacaagcgaatctgtgatgaaacaaacaaaccaggcaaaccatcgtggcatggacatatttctgaaaagagtgacacctcctcaagaagagcctcaggtccttcaggaggtattccagaagaagacattgtcatcatagatgaccgcttcatgagtgttattgcccctaaacatcttctagtgggacaagatgtggagatggaagacagtgatactgatgattctgatcctgtgtaggcctaggctcatgtgtgtgtttgtgtcttagtttttaacaaacatgtttaaaaagcttaaaaaatcttttttttttttttttttgcgacggagttttgttctccttgcccatgctggagtgcagtggcacaatcttggcctcactgcagcctctgcctcctgggttcaagccattctcctgcctcagcctcccaagtagctgggattacaggcgcctgccactaagcctggctaattttttgtatttttagtagagatggagtttcaccatattggccaggctggtcttgaactcctgacctcaggtgatccgcctgcctcggcctcccaaagtgctgggattacaggcgtgagccactgtgcctgtccagcaaatcttaaaagtacaaaaaagcttatagaataaggatataaagaaaacatatttttgtacagctgtacaatgtgtgttttaagctaagcattattacaaaaaagtcaaaaagttaaaaaaatattaaaaaacttataaggtaagaaagttacagtaactaagcttaatttattttaatttattgaagaaagaaatattaaaataatttaatgtaacctaagtatatagtgtttataaaatatatagtagtgtacagcaatgtcttagaccttcatattcacttactaacttacccagagcaacttctgatcctgcacactccattcttggtgggtgtcctacacaggtgtaccattttaaatattttataccgtaatttttttgttccttttctgtgtttagataggtttagatacacaaacacttatcattgtgttacagttgcctatagtattcaatatagtaacttgctgtacaggtttgtagcctaggagccatagagtattccatatagcctacatgtgtagtaggttatgtaccatataggcttgtgtaagtatgctctaaagaggcattgaatgtatctccgttgttaagtgatacatgatatagttgagtgaatggctaagacaaatggaacatgattgtccagcagcattaagggcccatttgaggacagatacatgaaattggcattatggaaggattgtcattagtggtaataataagatttaggatatggagtaagtggttaagatagggtatagaagatctttggaagagaaagggttcaggagaaccaagaggctacatggtagaaggctcacctacatgtatatgaaaatctccaaaagttaagaattgtagtcagagagagtgacagaggctaatattgttgcaaaatgaagggcagtagactcaaggatccataaatggcatcaataggacatcactgaaagtggcatagtagggaactccagagctctgtctcgccacaaaaacaacataacgaagtggaaaaaactatcagtcaactttgctgctgtcttattcttccccagtcctttccctggttggtgtaagttttttttactatattctagagctctacaaagttaattgagagtgctgtggcattttaaattgcctgtctactagcccccacacccagatcagtggtggccatggtgatagaagcccacactcctggtgcaggttgctaatgctagagggagcaaagaattgtgtttttgggttttaatctggctacctgctccctgaaggacccacataggggcctacttttgtatcttttgactgggagtattctcagggctggtatggcttttgccaaaagcacttaaaggcacaattattgtctgtaatggcctggagcaagggacaacagctgagacaagcagtagtgagaccgaaaagcctgagaaggaagacattagaaaaagagatacatggggaaaaagagctttttacaaagttgtcatatataccataagaaggtcatgcttatgctcagagctgggcacatgcccagaaaaggccaacagagaccctaagctttctcttctgggtctgagtaggcaggaagtgaagactgaggcagagctgtgaatggtctggccaaactttgaggagtgttctaatgcactctcttttcccatttatccaggcctttaaaaaaactgtcaatatactaattggtcactaagctaacagaacatagattcaagtggccacacgtgatgaagaatacaaactttacaaaaaaagtttataaaagtcactaaacacacacacacaacaataaatccacaataagcagcatcaaccaacctctgggtatttgggggtggagaagaatctaatctccatagttgctacataatattaaatatgtccagtttttttttttgtttttttttgaggcagagtctccctctgtcacccaggctgaagtgcagtggcacaatctcggctcactgcaacctctgtctccaggtttcaagtgattctcctgcctcaacctcctaagtacagctgggactacaggtgcgcaccaccatgcctgactaatttttgtctttatagtaaagacagggtttcaccatgttggccaggctggtttcaaactcctgacctcagttgatctgcctgcctcggcctcccagagtgctgggattacaggtgtgagtcactgtgcccagcctagataaggaattgaaatcaatagtcctaaaatgctttatgagctaaaggaaaccaggagtgtgctgtctcaccaaataaatagagaacatccataaagagataaaaattatgaaaaggaaccaaacaaattctggagttgaaaagtacaataactgaaataagaaattcactgtagaggttcaacagtagaattgagcaggtagaagaagccaagccaaagaaagaacactggttaaagtaactctaggtaaaatataaaagccagtactattacatttgtggtttgtaagtcctctttttttcctatatgacttaaaagacaaatacataataattatgaatctttaaaaagataatttcaacttttattttagactcggggtacatgtgcaggtttgttacctgggtatattgtgtgatgctgaggtttggggtacaattcatcccatcacccaggttataaatctgtcaaatggcacactataaaaatgtaatttgtgactaacaataggtggggaggggcagggatgtataggtgcagaggttttgtacactattgaagtgaagttggtattaattcaaactaggttgttttaagtttaaaatgttaattattatacccaaaggaaccactaagaaaataattaaaaactaaacagaaaaaagaaggggatcaaaatggtgcacacacacaaaatcaaacaaaaaaggcagtgatagaggaaatgaggaacaaaaatatgacagaaaacaggtagcaaaatgatagaagttcatccttatctataattattttgaatgtaaatggattaaacccaccaattaaaaggcaagagtttggcagaatgtataaaaaatcatgatccagttacatactgtgtataaggaactcactttggatttagagatacaaatagcttgaaactgaaagtatggaaacatattctgtgcaagcattatgctggagagacctggggtggctatgctaatatcaaagtagactttaagacaataagttgttacaagagacaatgaaaaacattatataatataaaatggataacccattgagaagatataacagttataaacatacctgtaccaaacaacagagccccagagtatttgaagcaaacattggcagacttgaaggaaacatagttgtgtaattattggacatttccataccctactttcattaatggttagaacaactaaccattacttgacaaaagatgagtaagaaaatagaacacttgaacaacgttatatatatagaacattacacacaacaacagaatctacattcttctcaaagcacatggaacattctttagaatagaccatatattaggccacaaaacaagtctcagttgaaatcatgcaaaatatcatctctgaccacaacagaatgaaactagattgcaacaatagtgagggagtagtgagtgatatgaaattcaaagctgggtggatagagggagaatagtctggaagcaacaataacaagcaaaaagaaaactgccacatcacctccaggcctggtagtgtgaggcgtctgaggaaaacagctaccagttaactgcgttacaatggcagggctgttctcagggtgaaccaggctctgtgtgagcaccacggtgaaaagaacctttaaatgagaaatttggatatagggaattttgctgagaatggatcatgaattccatatgattccgtggaagtatttcaaggatgtggaaaggtatgatgggacagaacagggattgtgcataacagtatgtggatgagagtgtggggcatattgtggtgatgtatttaaacaagaatgaagggagtaatgaatgtggccctggtgcattcaagtcaggtagtggaggacaggttgtcaataagttaaataagcttttgtgagtttgttttgaaaccctggccacaattcatttttatgggaaaatgttttgctactaagtaaccatttataagcatttatttttacatgtttttaaaattattttgagatggagtctctctttgtcgcccaggctggagtgcagtggcgtgatcttggctcactgcaacctccgcctcccgggctgaagtgattctcctgcttcagcctcccaggtagctggtattacaggtgcctgccaccacgcctggctaatttttgtatttttaggagagacggggtttcattgtgttgtccgggctggtctcgaactcctgacctcaggtgatctgaccaccttggccttgcaaagtgttgggattacaggcgtgagccactgtgcctggcctgtaagcaaattagaattaggaaactattgttacattgaagacatctcatctgtttttaaaaaatagagtgaaacaatgccttctataaatgatgcacattagtttggttagctttgtattttatttgcataatatcataattgtgggaggaacctcacatacaaaggtctcattttcagtattgactataaaaagaacatagtgtattgttactgtttgctttttatttacatttggccagttagttattgccagttattctcacttcactgttccattcatctgacctcagcagtgttaaaattagctttgaaaattgatagcattcaaagattcttatgtttctatgtagggtcctcatggctggcctggaattgactttgccattctgtactttaaaacatcgatttattcatctgtaatatttatgtacacctgttttgtggagaacatcagctgacagccagatatacttagcataaaacccaagaaataaaattaaaggaagaaaaatataaagcaaatgctgatggttcttctgcacttgacagtttgtctatctgcgtctccactaagaactaacttgaaaaagcaagttaagaaaacacacatgtgtatcagccaggcatggtggctcatgcctgtaatctcatcactttgggaggctgaggtgggaggatcgctagagcccaggagttggagatcagcctgggcaacatagtgagaccccatctctactaaaaaaaaaaaaaagctgggtgtggtggcatatacctgtagttccagctactcaggaggctgaggtgggaggatcgcttgagcctgagaggtcaggactgcagtgagccatgaccatgccactgcactccagactgggtgacagagtgagaccctgtctcaaaaaaaaccctccaaaaccaaaaaacacacaaaaaaacagaaaagaaaacacacatataaacagaactgcagactaaatcttgtgcattataaaatctcacttatgctattcagctgtgagattttatttaaatgttaacctgcattgtaaattgtgtccgtttttgaaattgctttccttgtgttcttcagaagatgttccaatgtgaaaagggatgttggcataataatccttgtactgaattcagatatttggtaagataaggaagagcagtgaagcattttcttggcctagagtatttgatctaattgttcttagttattggtaggtgaaggatattgctttaattgtcctttctgcactaaatggaaacttttttttttatatttctaggaaccaaatggcgagacaccatcatctttatacagagttgcagcagtacttctacaatttaatcttattgatttagatgatctttatgtacatgtaagtcaagtgggctgctaagaatacttgattgtctgtcccaagggtagggaagaggagtaggtagccacatagcacccccaggattgggttggttcgaggttctcaagtctcactctttgaagccccaatacattgttgatttgtgtttactttataaagtgaataaatttagttatttggcagtctatgaaaattaaatacctttttggtcacctttatggagtttaagttttggtcacctttatggagtttaagtttggatatgaagttcaagttcttaactgtcatcaaggcatagctcatggggagagaggccaagttctaaccaatgtggttttttaagcctttttattatctacaaatgatgggaaatataaagttacctatatactgcttctttctctctaaaatgttaattttaggcattcaggatgaatggggaacttcattagtgtatttttatatttagtatatttaaaaaatatttttcttgtgttattcgtgtgcactaaatgactattatgcttttattgctggacccaggatgtagaagagttcatgattgtggcagatgacctctagtttaacaaaaatttagtcatcagtttcagaatctaggctaatagtatataaattcctcttctattaggttttgtattaggatatctattaatttaaaacaagtatgtccaaaggtgatatcatcttcactgcctttgagatcactttattaacatcattgcctatttttgtatactgtggctacagagttgagtaaaacttggtctttaccttggaagcagtcatactctaggaagggagaaaaaaattttgcattatttaataggtactctattggagatattcacaaagctcagaatagatagtgaccatatctgtcttgggggattttggaagactttcccaaactagtgatgttgaactgggatcttgatagacaagtaggaccatctaggctgaaatggtagaaaactttgtaggtagaattaactgagtataaaggcaggagttgttgttgttgttgttttgagacagagtctcactgttgcccaggctggagtgccgtggcactatctcggctcactgcagcctctgcctcctgggttcaagtgattctcctgcctcagcctcccaagtagctgggattacaggcgcatgccaccatgcccaagtaatttttgtatttttagtggagatggggtttcaccatgttggccaggctggtcttgaactcctgacctcaggtgatttgcctgcctcagcctcccaaagtgctgggattacaagcgtgagccaccatgcccagccaaggcaggagatttgaaagggcttttttatccccttatgggactgtcaggaagctcagagtggttggagcctagggtggtatatagggggaatgaggatggaatagagaaagctaaactgttaacggcttaagtgacatagtaaggaatctggatttttctcttgggagtggagagccatattagtatttaaaggagagatgtgatgtagaaactgagaatatggaaaagtggacagaaaagggaaaatttaaaaacacaggtatgactttagagggaagtatagaccggcatatgtggaaagtacaaattgatgatagatttattactcattatgattgcatttagcagtaaatgtaagcagactgagtggtcctgttaatatgacaaagattgtcaagtggaattaaaaatgagtttattatttatatgagaaacagcttaaacttaaggataatgaaatgttgatagtaaaaggatgagaaaatagatcagcaaacttactgttggacaaaatagactttttggcagaaggagataaagcgggctacttcataataacaagattgtgctcactaggaagataaaacagttctaactttacatgtatctaatgacatattctcaaaatacacagaaataaaagttgagagaactataagaagaaacagtttggccattagagggagttgtaattgtctgggtaaaagataaggacctatggccgggcgcagtggctcacacttctaatcccaacactttgggaggccaaggcgggcagatcatctgaggtcaggagttcgagaccagcctgaccaacatgctgaaatcccatctctactaaaagtacaaaatcaccctggggtggtggcacatgcctgtaatcccagctactcgagaggctgaggcagaattgcttgaagccgggaggcagagattgcggtgggccgagatcgtgccatttcactccagcctgggcaacgagagcaaaactgtctcaaaaaaaaaaaaaaagtaaaaaataaaacaagaggacctgtgccaggtgtataagtacagcaatacaaatgtgtttgattgccaggggagaacatacagaatgagaaaaagtcttgcttacttccttgcaccagtccatagtgacttttctctctccctccctcctttttttttttttgataaatggaatgaaatctataatgtttaatagttcattattattttcatttactgtttacattaaacctagttaatggaatagattatgcatttctaggggtcaggaacactccttttatagcttatcatagtgactagcagaaactactgagtaatttgttgcctaaagttttctttgtgttagggttattttataaatgtcttcattaatcatcttccactcatacaaggtgactgtttgagatacttgagcctttttcataatggagggttgactatgcacatagtactttttcttttgcaataaattagtaactagcttgtgacttaaataagctcctagaaaaagtgagatgtcaagttactaataatttttctacttgaaatttttcatttagatgatttaaatttatccctttgtgttattcagtagttcacctttcccaaattggatccatattgcaatgctttatttaatttggagtttagcctttaatggggaaatttgtaatgtttttaatggaactgctatatattttcttgggtaaactaataaattcaacggaaaacatcactgttgtggtattacattactttagggactctgtcagacagaagatgtgaaactttgagctgcgacttgattttaaaaggggtacagaattcaggtacttcattctgtcaaattataagaaaataactgaaatttacttagaaggcaaatggtcacgaataagttagacttcttatttatagttttatcaattgagaatagtgtttcctttttatatgaacaagtagttggtattagctattttatgaaattttaatgtaccatttttagcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaagtatgtaattcattctagtaaaattaacactatcttctggattttgaattatgaaatttaacttctaaatagtcatttatggaagaataatttcttagttttcattttgctgaaacctcattttctggatcatttgctacagtggttttatttttaatctgaatggctcctttttaagagaagctgtcatattttttttcttgtataaatttcaaaatgttttctaagtaaaatcacaagttgtattgactttaattgtcctctgtgtattagtggccctcaaatcctaaagagattctcagagatgatgaattctggtttcctgtggcacgacataacatgaagtagaacttaattccaagtctataaactgtaatgcctgtgtctgtttttttttttaataaatttattattatttttgagacagggtctcactctttcacccgggctggagtgcagtggcatgattacagctcattgcagccttctacctcctgggctcaagtaattctccagccttagcctcctgagtagctgggactacaggcatgcgccaccacacttggctaatttttgtattttttgtagagatgggatttcgccatgttgcccaggcttgtctcaaacttctgagctcaagtgatctgcctacctcagcctcccatgttcctggactataggtgtgagccgctgcgcctggccctgatgttttttcaatagctaaaaattttgattgtacttgcaggaatatattgtttaatttcccatgaatagcaaatatttttgatgtgttgcttaggtcagttttttaagtgacaaagtattaagatttcttgatgtctgtatcctgagtatcttagttttgactattcatttttagccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaaggtatgtaactttatactttattaatcattgaggtagaaatagcttaggactacaacaaaatgtatatttatcttatctcctcaaaccaagcatatattttagtaccttttatcaaaagataagaactattcacagagtgtatcagtctgatatatattaatcagtgacttgtcttctaacgtctagaccaggggttctagaatgtgtgctgcagtgtagtctgaaaactacaagttagacttctaggttgggtttgttccattgagagttgaaactccattcttctggttttgactttccctcctttcagtgggtgggaggggcaaagaattcctgaggttttttcttagtgtaatttttctccatcctggctgagtggctctgagtgaggacattgcctctctgattcccttacctttcctggcatataggctgctgttctggaaattagtagtttagcctctcttatcatccccagttactatgtcatctagtcctttagctttctgcctacttgcaggatacttaggagcagtattgatagcagctgtggctacagccccatagatcagagcctgcctcaaaagcctcagccttgtgacttttgtgtagctgctggttgctgccgtcagtgtcacttcatgggccgtggaccatgcaggcttcttagagagtgacccctgtgactccacagtggggcacctgctgagcaggtgagaactctgggtatggtgtcctaaagtgaccttcttttattacatggctcactttccctacgaccacattctacataccctaggttgtggaatccagattgagaaatgtcagttgacttgaatcagtgttgttatatccatatttttctgtttcatcttccagtgcatcttaggtccatcccttgttgcccattcccatatccaagttcccgataccggccaagtttaaaaacagattcagatggtgtgtgttaaatgttccttgaaatccacacttctctgattaagcagttaatttggaacattctcctctgagctctgattttttttttctaatgactgttgtttttatgtgtttctaccagttgagaattatctggtgtaataaagttaggcacaattgaaatgtagaaagcaaatatgagcaagaaaaaatttcactgattaagataactttgttaaaatggtagatattgtagtgtgtgtgtatatagttatatttattatatacttatttatttgtttatttatttattttactttttaaaatagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggaggtaagtaagatttttcttacaaacctaaattttgaaatgaaaatattctgagtatacttgtgttatgagtatctttagaaataaaaatatgaacctcatttaataaagggttatgttgagtgaggtttgtggaaaattccagtgtgtcctaaccatatgcagtcaagtgttgcttaatgacaggtgagaaatgcatcattaggtgattcgtcattgtgcaaacatcagagagtgtacttatacaagcctagatggtatgacctactacatacctagactatatggtatggcccgttactcctaggctacaaacctgtacagaatgttcccgtactgaatactgtggggagttgtaatacactgttaaatatttgtgtatctgaacatatctaaacatttaaaaggtaataccttgcactaagatgttaggacagccatgatatcactaggcaataggaattttttagctctaatataatgttatatgaccctggtcatatatgtggtccatcaaccgaaacattgttaaatggtgcataactgtatatattaatataaacccaaatctagcgagattattagtcaagtccctcacatgggaaaatatacttcagacaagtggctgcttttttaattcccttatgattagtggttacttagcattcttttccttctagtcattttcttgagtgtagttttcaatcattgctgctatgtgtaagaagtcttttcagcctcagactgttaaggacccattcttttatttatttattcttttactaagatttttattgaaataaaacatacatacggaaaaatacagctcagtgactttccctaaactaagcacccatatgtccactacccaactcaaatagtttacagtcccaccaacagtgtgaaagtgttcctatttctccacctcctctccagcacctgttgttttctgactttttaatgatcgccattctaactggtgtgagatggtatctcattgtggttttgatttgcgtttctctgatggccagtgttgagcattttttcatgtgtctgttggctgcataaatgtcttcttttgagaagtgtctgttcatatccttcgcccacttgttgatggggttgtttgttttttcttctaaatttgtttgagttctttgtagattctggatattagccctttgtcagatgagtagattgcaaaaattttctaccattctgtaggttgccagttcactctgatggtagtttcttttgctgtgcagaagctctttagttagttagatcccatttgtcaattttggcttttgttgccattgctttttgtgttttagacatgaagtccttgcccatgcctatgtcctgaatggtattgcctaggttttcttctagggtttttatggttttaggactaacatttaagtctttaatccatctttgtggaagacagtgtggcgattcctcaaggatctagaacaagaaataccatttgatccagcaatcccattactgggtatatacccaaagaattataaatcatgctgctataaagacacatgcacatgtttgtttactgcggcactatttacaatagcaaagacttggaaccaacccaaatgtccatcaatgatagactggattaagaaaatgtggcacatatataccatggaatactatgcagtcataaaaaaggatgagttcatgtcctttgcagggacatggatgaagctggaaaccatcactctcagcaaactcacaaggacaaaaaaccaaacaccgcatgttctcactcataggtgggaattgaacaaggagaacacttggacacaggaaggggaacttcacacaccggggcctgttgtggggtgtggggagaggggagggatagcatcaggaaatatacctaatgtaaatgactagttaatgggtgcagcacaccaacatggcacatgtatacatatgtaaccaacctgcacattgtgcacatgtaccctagaacttgaagtataaaaaaaaaaaaacagaatagtacctgcaacctagagtctttctcatgctgcattctagttactatcctaaccataaccatttatgctttttttttttaaaaaaatcagctttgaggtataatttaaatacagtaaacttctacaattttatgagttttgacaaatgcatacagttgtatgttcaccaccacaatcatgatatagaagttccctccttccattgctgttcctggcaacctctgataggctttccatcactatagttttgctttttctacatcttatttaataaatggaatcatatggtatatactcttttcagtctagtttcttccacttaagcttttgagatttatccaagttgcatgtgtcagtagttcctttattgctgagtgatattttattacatagacgtaccagagtgtagccaccagttgatgggcgtttgggttgtttctacctggaggctattataaagctgctttcaatattcctgcacaagccttttgggaggcatgtgtttttgtgtccccaggggtgggattgatgggtcatatgagtaagtatatgtttaatttcataagaaattgccaaactgttccaaagcatctgtaccattttgcattcctaacagctattgtatgagacttctaattgttccacattcccaccaacacttgttgttgtcactcttttaagttttagtcattctagtgggtatgtagtggtatctcactgagcttttaattttgttccagtgactagggatgttgatcatcttttcatgtgcttatttgccatttatagttatctttagtgaaatgtctgttcatgtctcttgcacatttttaagttgcgttatttgtctttttattattgagttgtaagagttctttattctggatgcaaggccttatcagatatgtgatactgtgaaatttttttcttagtctgatttgccttttcattttgttaactatcttttgacagcaaaaaattttaacgtttaattctgatttagtagtattttttttttttttttttttttgagacggagtctcgctctgttgcccaggctggagtccagtggcgcgatctcggctcactgcaagctccgcctccctggttcacaccattctcctgcctcagcctcccgagtagctgggactacaggcgcccaccaccacgcccggctaattttttttgtatttttagtagagatggggtttcaccgtgttagccaggatggtctcgatctcctgacctcgtgatctgcccacctcggtctcccaaagtgctgggattacaggcatgagccaccgcgcctggccagtatttttcttttatggtttgcttttcatgctctaagaaatctttgcccagcccaaggttttaaagctgaaaagaattatacatagtttctttaaagttgtgaatcatgacaactaaaaaaaccatctagacattgttaaaaaggacaaatgcagggtgtcttcagtgtttggtgattatatctaatttgaattttagacaacagcaactgtatagaaatactaacggctattgtgtattaatttcttgacatctgaaatatttgacttggctttttatacttagctggtagattttttttgtttgtttttgaggtaggattgcactctgtcatgaaggctggagtgtaagtggcaccaccatggctcactgcagccttgatctctcaggctgaagggatcttcccgcctcagcagcccaagtagctgggaccacaggtgcatgcgccatgcctggctaattttttaaatatttgtagagacagagtctccctatgttgcctaggtaggttgtttttaatgctcacaaatttacattatgtaaaggtactctaaagaaatctgttaagtagttaattattactatatatattgtttattatataatattcatatgaaatggaagtatatcatttctaaatgttgggaacattctaagtcctctgttctgactattttgaaatatataatacattgttgttaactgtggtcaccctactctgctattgaacattggaattcattccatcgatctaactgcatatttgtacctattaatcaacctctgtttattccccctcacccccagcctctgttatctgtcattctatcctctccctccatgagaccacttttttgtttttttgggtttttttgtttgttttgttttgtttttttttgagatggagtttcgctcttgtcgcccaggctggagtgcaatggcgcgacctcggctcactgcaacctccgcctcctgggttcaagcaattctcctgcttcagcctcccgagtagctgggattacaggtgcccgccaccacgcccaactgatgtttgtatttttagtaaagacagggtttcaccatgtttgctacgctggtctcgaactcctgacctcaggtgatctgcccttctccgcctcccaaaatgctggaattacaggcgtgagccactgtgcccggccatgaggccacttttttagctttcacacgagtgagaacatatgatatttgtctttctgtgcctggcttatttcacttaacataaagaccttcagttccatccacattgctgcaaatgatatgatttcattcttttttatggctgaatagtattccattgtgtatatatatatacaccacattttctttattcattcatcagttgatgggcacttaacaggttgattccatagctttgctgttgtgagtagtgttgtaataaacatgagagtgcaggtattcttttgatatattgattacttttcctttggataaatacccagtaatgggattgcttgtaacaaattatcacaggtaccccacaaatatgtacaaatatttgtaccagtaaaaaatttaaagaaatttagaaaggaagtataataatgtttcactcttgatttttattgtctgaaaaggatgattcatgttagctagtgcctgctcaagaaacaaaagggctgtatttttttccagtgcatcatatcaggtgcatgtgaagtcactttgttccattgctggtgatgttaactttatcatttggttaagatgatctctgccaggtttctccactatacagttactatttttccctttgttattaatatatgtcttgtgggaagatataacactttgagactatataaacagactgtttctcctcatactttcacctacctaatgctgctcttttaacttgaaaatcttaatgttcagatctcttgttctgaaattctttggttataaatatcaaacttgtgagcaggagaccaaaccttcaactcatggaagtcctgtacataaccatatacaatattattaccaagatacacacttggtagagctgtcacacttcccctcttgccttctccattgcattcatcctgtacacccgttctgccctagttgtgccaggttcctgcgttaactccagtctattcttgcagagatgaagggcagaagggaagagaaaaatgttagttttgaccatagagaccagtgtaagaagaaatctgcgttttctcattactaggtttgtgatggaaaagtgaatccttacagttatctgagttagaattttgatctatttttacccataaaagattttgctgtgacaaatcatttgttctgtgtttaaatggcttttgttgtctagcttggaattcaagcaggatttttaagattgcttctaaagggtgaatatgaccttagttccaaataatgtatttacaattacacttctttaacaaatctcatttataagcttagggttgcttttatatacaaattatgtatatttttaaaaagaggcttatatacttgtaccagatatcacttaacagaattatcttccagccctatagttatttgtaatttatttctctgattatgtgtatatatgtttcttaaatttgaggtatgtagtatataggactaactcctagtacagtgattctcaaacttcagcatgccttgtaatcacccagaggacttgtttttgtttttgtttttttttgagacgtagtctcgctctgttgccaggctggagtgcagtggcgcaacctcggctcactgcaacctccgcctcctgggttcaagcaattctcctgcctcagcctcccaagtagctgggactacaggcacgcgccaccgtgcccagctactttttgtacttttagcagagacggggtttcaccatgttggccagaatggtcttgatctcttgaccttgtgatccgcccgcctcggcctcccaaagtgctgggattacaggcgtgagccactgtgcccggccaaggacttgttaaaataaattgttgggccccatccttggagtttttgattcagtaggtcttgagatgagaccttagaatttgcatttctaataagttctcctgtgatgttgatgctcctggcccaaagaccaaactttgaggattcttgttctaggcttaagcagtggaggagtgtagtggttctagaattgtttcatgtaaaaggacacattttgctataataacattttctttaattatagagcactaacatgctcacctgacatactcaaatgtttttgatagcacctatatattttttagactttattttttagagcagttttaggttcacagcaaaatccagaggaaggcacaaagatttgctatatagcccctgttcccatatgtgcacagcctcccttgtaatcaacatctcccaccagagtggtacatttgttacagggatgaatccacattgacacatcacccaaagtccatagtttacatcaggatttgctttgtgttgtacatactagggatctcatcaaatgtatagaatattatcactgccctaaaaaatcctctgtgctctgctcatttatccctctctcctcacaacccctggcaaccactgagcttttcattgtctgcgtggttttgccttttccagaaaggcatatagttggaatcagatagtatgtagccttttcagattgttttctttcacttagtaaaattatacacatttaggtttcctctgtgtcttttcatggcttgatagctcatttctttttagcactgaataatatttcattgtctgcatgtatcacagtttatccattcacctactgaaggacatgttggttgcttccaagttttggcaatcaagaataaagctgctgtaagcacctttgtacaagtttttgtgtggacctaggtttttgatctactctgacagtctttgtattttaattggtgcatttagatgatcagtgttcaaagtaattgatatatttggattaatattaatatctaccatttttcttattcttttttagtttttgcccctgttttttgttcttgtttttgtcttccactcttttcctgccctttctggcccatttttggttaagttttttagtgattaccccacagtttgcaatgtacatttacaattgatccaagtccactttcaaacacactattttgcttcatgggtagtgtgagtaccttacaataacagcataatcctaattctttcctcctgacccttgcatcactgaagtcattcatttgcttatacacacacacacacacacacacacacacacacacacacacacacacgcatatgcgtatgtaatcaaatacattgttgctattattattttgaacaaacttatttttgttatattagttaagcataagaaaaataaacattttaccttcacttaatcttacttcagtgtttctttttttgtttgtttatatatatccaagtttctgacctatattctttctctctaaagaacttacttagtatttcttgcaaggcaggtctactggcaacaaattccctcagtttttgtctgagaaagtctttatttctcctttacatttaaagtataatttcacagggtccagaattctagtttttttttttatcttaacactttaaatctttcactccactctgcttgcatagtttctaaggagaaatgttttaaattcttatccttgcttctccataagcaaggtgttctcccccacacccagcatcttttaggattttttctttttctttgattttctgtagttataacatgatatgcccaagtgtagtttttttgtttgttttatttatttgtttatttatttatttatttatttactttttgcatctgtcttgcttggtgttttctgagtttcccgcatctgtggtttggtgcctgatactagtttggggaaattctgtcatcattgcttcaaatatttcttctcttccttccttccttctgctatttccattatgcatatgttacagttttttagtcctacagttcttggatattctgttctgccttttatcagacttttttctctttgcttttcagttttgcaggcttctatggagatatcctcaagctcagaattttttcctcagccgcgttatctcccaataagccatcaaaggcattcttcattctgttacagtgttttttatctgtaggatttctttttttattttttcttaaaatttccatatctctgcttatattgcccctgcccttttttttgaggtggaattttgcttttgtcatccaggctggagtgcaatggcatgatcttggctcactgcaacctccgccccctgggttcaaggagttctcctgccttagcctctctagtagctgggactataagcatgcgccaccacacccagctaatttttctatttttagtagagatgaggtttcaccttgttggccaggctagttttgaactcctgaccttagatgatctacccacctccgcctcccaaagtgctggaattacaggcgtgagccaccatgcccggctccccgcctttgtttttttgagacagagttttgctctgtcacccaggctggagtgcagtggagtgaccctggctcactgcaacctccgccttctgggttcaagcaattctcatgcctcaggctcctgagtagctgtgattacaggcacgtgccaccatgcctggctaattttttatatttttagtagagacggggtttcgccatgttggctaggctggtctaaaactccttgcctcgagtgatacacctgccttggcctcccacagtgctgagattacaggtgtcaaacaccgtacccagccagtcacggaatcttgtttgtctttttccctcctagaagtaaatagcataagttcctctctctctctctctctctttttttttttttttttttttttagacggagtctcgctcttgttgcccaggctggagtgcagtggcatgatctctgctcactgcagcctctgcctcccgggttcacgggttcaagctattctcctgcctcagcctcctcagtagctgggattacaggtgtccactaccacacccagctaatttttgtacttttagtacagacgaggtttctccatgtttgccaggctggtctggaactcctgacctcaggtgatctgcccaccttggcctcccaaagtgctgggattacaggcatgagccaccacgcccggccattaagttcccttttttttttccccagacagagtcttgctttgtcgccaggctagagtgcagtggtgcaatctcagctcattgcaacctccgccttccaggttcaagcgattcttataaatataaataaaatatattttatttattgtgttaggaatgggggagagagattctgtgtttatgttttactctgccatggtaattaatttgtctagaaagactgtatatgtggctatttcatacgttggcgcttggtaaaagccaaagtgctctaaattgatttacaaataaagcttagtaaaacctgaaattaggcaggcagaatataccccagactgggtattagatgacattaggaaataggtgagatagtgatcttgtgttaatatggcggcatgtccttgttcttaggagacaccctgaattattttgagaaacgtgtcatgcctgcaaatttttttggtctgccgaaaaaagggcaaaatgttaattgttgaatttagcaggtaggtatatatagctgtttagtatactatcctttcagtttttatgtaatttgaaatttttcataataaaaatttggattgcaaggagaatgtgccttagaccagtagttccaaaactgtagtttataaaccaaatgctttagaactttgaggctgatgtttactactttttgtttttttgtcagctattacaggagggggagtctgattctgcttcattccacttatttgttttcaaaattgaaaatctgtcttggttatgtagcttaaagcccaagattcttcatagagtagttttaagaaataaatgcgaaggttttagtctgtacgtggcacatagtgagtactaaataaattgtagtaagaatgagaagaaggaggaagttgaaaatagtgttttaattcacacagtttcaggttccagtcttttcaaaaatcttgtgtttttttcctctctcttctgagacataatcctgagtagtgtttgaaatgttcaaggggcagggatacgaaaaatagatcattagtaataaaaaattatctagttatatctacaacttttccatttattccatgactccccaaaaaccctcctcctaataaacctataaacctatatattttttgtgtgtcctgtactgttatgcagcccgatcagctactgtgtctttatagggcaattttggaacttgttttgggccattcagctaatagcctatataggcataattgtggctagttttattcaaacttttttttttttttttttttttttttgagacggagtctagctctgtcacccaggctggaatgcagtggcgcaatctcacctcaccataacctctgcctcctaggttcacgcgattctcctgcctcagcctcctgagtagctgggattacaggtgcgcgcccaccatgcccagctaatctttgcatttttttttagtagagaaggggtttcaccatgttggtcaggctggtcttgagctcctgacctcgtgatccgtggtctcagcctcccaaagtgttgggattacaggcgtgagccactgcactctgcctattcaaacttaaaaattcagttgctcacaggcaagtgtgtgtgtatatatatatatatttattattattattatactttaagttctgggatacatgtgcagaacgtgcatgtttgttacatagatatacacgtgccatggtggtttgctgcacccatcaacccatcatctacattaggtatttctcctaatgctatccctcccctaaccccctaccctgctacagacccctgtgtgtgatgttcccctccctgtgtccttgtgttctaattgttcaactcccacttacgaatgagaacatgcggtgtttggttttctgttcctgtgttagtttgctgagaatgatggtttccagcttcatccatgtccctgcaaaggacatgaactcatccatttttgtggccgcatagtattccatggtgtatatgtgccacattttctttatccagtctatcatttatgggcatttgggtgggttctaagtctttgctattgtgaacagtgctgcagtaaacatacgtgtgcatgtgtctttatagtagaatgatttataatcctctgggtatatacccagtaatgggattgctgggtcaaatggtatttttagttctagatccttgaggaattgccacactgtcttccacaatggttgaactaatttacaacagtgtaaaagcattaccatttctccacatccttgtcagcatctgttgtttcctgactttttaatgatcaccattctaactggtgtgagatggtatctcattgtggttttgatttgcatttctctaatgaccagtaatgatgagcatttttttcatgtttgttggctgcataaatgtcttcttttgagaagtgtctgttcatatcattcgcccactttttgatgggttttttttttcttgtaaatttgtttaagttccttctagattctggatattagcccttttgtcagatggatagattacaaaaattttctcccattctgtaggttgcttgttcattctgatgatagtttcttttgctgtgcagaatagtttaattagatcccgtttgtcaattctggcttttgttgccattgcttttggtgttttagtcatgaagtctttgcccatgcctttgtcctaaatggtattgcctaaattttcttctagggtttttcgggtttgaggtcttaacgtttaagtcttttaatccatcttgagttaattgttgtatatggtgtaaggaaggggtccagtttcagttttctgcatatggctagccagttttccaacaccatttattaaataggggatcctttccccattgcttgtttttgtcaggtttgtcaaagatcagatagttgtagatgtgtggtgttatttctgaggcttctgttctgttccattggtctatgtatctgttttggtaccagtaccatgctattttggttactgtagccttgtagtatagtttgaagtgaggtagcatgatgcctccagctttgttctttttgcttaggattgtcttgggtacacgagctcttttttggttccttatgaaatttaaagtagttttttctaactctgaaaaaagtcactggtagcttgatggggatagcattgaatctataaattactttggatggtgtggccattttcacgatattgattcttcctacccatgagcatggaatgtttttccatttgtttgtgtcctctcttatttccttgagcagtagtttgtagttctccttgaggaggtccttcacatcccttataagctgtattcctaggtattttattctctctgtagcagttgtgaacgggagttcactcatgatttggctctctattattggtgtataggaatgcttgtgatttttgcacattgattttgtatcctgagactttgctgaggttgcttatcagcttaaggagattgtgggctgagacaatggggttttctaaatatacaatcatgtcatctgcaaacagagacaatttgacttcctctcttcctatttcagtaccctttatttctttctcttggctgattgccctgaccagaacttccaatactatgttgaataggaatggtgagagagggcatccctgtgttgtgctggttttcaaagggaatgcttccagcttttgctcactcagtatgatattggctgtgggtttgtcataaatagttcttattattttgagatatgttccatcgatacctagtttattgagagtttttagcatgaaggggtgttgaattttctcgaaggccttttctgcatctattgagataatcaggtagtttttgtcattggttctgttaatgtgatggattacgtttattgatttgcctatgttgaaccagccttgcatccccgggatgaagccaacttgattgtggtggataaactttttgatgtgctgctggattcggttttgccagtattttattgaggatttttgcatctatgttcatcagggatgttggcctgtgtgtctgccaggttttagtatcaggatgatgctggcctcgtaaaatgagctagggtggtgtccctctttttctattgtttggaatagtttcagaaagaatggtacgagctcctctttgtacttctggtagaatttggctttgaatccgtcttgtcctgggccttttttggttgttaggttattagttactgcctcaatttcagaacttgttattggtctattcagggattccacttcttcctggtttagtcttggggggggggcgtatgtgtccaggaatttatccatttcttctagattttctagtttatttgcgtagaggtgtttatagtattctctgatggtagtttgtatttctgtgggatcaatggtgatatcccctttataattttttattgtgtctatttgagtcttctctctttcttctttattaatctggctagcagtctattttgttaatcttttcagaaaaccagcttctggattccgtgatactttgaagggttttttgtgtctctatctccttcagttctgctctgatcttagttatttcttgtcttctgctagattttgagtttgtttgctcttgcttctctacttcttttaattgtgatgttaggatgtcgattttagatcttttccgctttctcctgtgggcatttagtgctataaatttctctctaaacactgccttagctgcatcccatagattgtggtacattttgtctttgttctcattggtttcaaataacttgtttatttctgtcttaattgcattgtttacccagtagtcattcaggagcaagttgttcagtttccatgtagttgtgtgtttttttcttaatcccgagttctaatttgattgcactgtggtccgagagactgtttgttatgatttccattattttgcatgtcctgaggagtcttttacgtccaattatgtgctcaattttagaataagtgtgatgtgatgctgagaagaatgtatattctgttgatttgaggtggagagttctgtagatgtctattaggtccacttggtccagagctgagttcacgtcctgaatatccttgttaattttctgtgtcgttgatctgtctaatattgacagtggggtgttaaagtctcccactattattgtgtggcagccaaaatctctttgtaggtctctaagaacttgctttatgaatctggatgctcctgtattgggcgcatatatatttagtatagttagctcttcttgttacgttgatccctttaccattaggtaatgcctctctttgtctttttttgatctttgttgttttaacgtctgttttatcagagactaggattgcaacctctgctttttttgctttctatttgcttggtaaatcttcctccatccctttattttgagcctatgtgtgtctttgcacgtgagatgggtctcctgaatacagcacactgataggtcttgaccctatccaatttcctagtctatgtcttttaatttaggggcatttggcccatttatatttaaggttaatattgttatatgtgaatttgatcctgtcattatgatgctagctggttatcttgcttgttagtcgatgcagtttcttcatagtgtcgatggtctttacaatttggtaggtttttgcagtagctggtttcagtctttcctttccatatttagtgcttccttcaggagctcatgtaaggcaggcctggtagtgacataatctctcagcatttgcttgactgtaaaggattttatttctccttctcttataaagcttagtttggctggatatgaaattcggggttgaaaattcttttctttaagaatgtttatttttagcccccaatctcttctggcttgtaaggtttctgctgagagatccgctgttagtctgatgggcttccctttgtgggtaacccgacctttctctctggctgcccttaacatttttttcttcgtttcaaccttggtgaatctgacgattatgtgtcttggggttgctcttctcgaggagtatctttgtggtggtctctgtatttcctgaattttgaatgttggcctgtcttgctagattggagaagttttcctggataataccctgaagagtgttttccaacttggttccattctcttcgtcactttcaggtacaccaatcaaacgtaggtttggtcttttcacatagtcccatatttcttggaagctttgtttgttcctttacattcttttttctctaatcttgtcttcacattttgtttcattaaattgatcttcagtctctgatatcctttcttctgcttggtcgattcggctattgatacttgtgtatgcttcaggaagttctcatgctgtatttttcagctccatcaggtcatttatgttcttctcttaactggttattctagttagcaattctctaaccttttttcaaggttcttagcttccttgcatttggttagaacatgctcctttagcttggaggaatttcttattacccaccttctgaagcctacttctgtcaattcctcaaactcattctttgtccagttttgttcccttgttgttgaggagttgtgatcctttggaggaggggaggcattctggtttttggaattttcagcctttttgtgctgtttttttctcatcttcatggatttatctacctttggtctttgtcgttcagatggggtttttgtgtggacatcctatttgttggtgttgactctattcctttctgtttgttttccttctaatagtcaggcccctctgctgcaggtctgctggagtttgctggaggtccactccagaccctgtttgcctgggtagctccagcagaggctgcagaactgcaaagattgttgtcttttccttcttcgggaagcttcctcctagaggggcacccgccagatgccagccagagctctcctgtatgatgtgtctgtcgacccctgctgggaagtgtctctcagtcaggaggcacagggatcagggacccacttgaggaagcagtctgtcccttagcagagcttgagcactgtgctgagagatccgctgccctcttcagagctggcaggcaggaacgtttaagtctgctgaagctgtgcccacagccgcctcttccccaaggtgctctgtcctagggtgttgggagttttatttataagcccctgactggggctgctgcctttctttcagagatgccctgcccagagaggaggaatttagagaggcagtcaggctacaccagctttgtgacgctgcagtgggctctgctcactttgaacttcccagcagctttgtttacactgtgaggggaaaacccgcctactcaagcctcagtaattgcacacgcccctcctcccgctgagctccagcgtcccaggtcgacttcagactgctgtgctggcagcgagaatgtcaagccggtgcatcttagcttgccgggctccgtgggggtgggatctgctgagctagaccacttggctctgtggcttcagccccctttccaggggagtggatggttctgtctcgcctggtgttccaggcgctactggggtttgaaagaaaactccagcagcagcagctagctcagtgtctgcccaaacggccacccagttttgtgcttgaaacccaggaccctggtagtgtaggcacagaggaagtctcctggtctgtgggttgtgaagactgtgggaaaagcttagtatctgggccagaatgcactgttcctcactgcacagtccttcacggcttcccttggctaggggagagagttccccgaccccttgcacttcccgggtgaggcaatgccccaccctgctttggctcgccctctgtgggctgcacccactgtttaaccagtcccactgagatgagccgggtacctcagttggaaatgcagaaatcattcaccttcttcgttgatcttgttgggagctgcagaccggagctgttcctatttggctttcttgccagccaccgaacccgtgatttctgagagttcatagaagttaggctgattacatttaaacaatttgccaggtctcaacaatccatatagctttttttaacttcccatttgatcttcttagatctgcaagttttattttccattttcaaaatcttttttttttttttttttttttgagacagagtcttgttgtgttgcttaggctggagtgcagtggcgtgatctaggctcactgcaacctcaacctccacctcccaggttcaagcgattctcctgcctcagcctcccgagtagctgggactacaggcgagtgccaccatgcccagctaattttttgcatttttaggagagatggggtttcaccatgttggtcaggctggtctcgaactcccgacctcatgatctgtctgcctcagcttcccaaagtgcttggattacaggcgtcagccaccgtgcctggcccaagtacagtttttgatcttcaagaggtgcctgtactctgtcctgttcatatttgaattcccaatgcctggaatctagtcattgaatgaatgaatgaatgaatgaatgcatgtctcttgttctccctccctgtttctgtctccctcccatttctagctggcattcagtaaaacttatagtattatgtgagagtcttacagttgctttgaattaaaaagcaaattaaactaaaagaaaaagtatcaagggagtagaatatattttcctaccaaacaaaagaaaattgcttttatttgcatgtacttcttgatttaattttgtacattcttgctataattcgactttgataggaaggtcttttactgctcttctagatggttttattttgcttcctatatttctttccccttttcaaattttcctgcttaatgaaatctagagaattgatgtttgaaattgatatgaaacctagagaatagatgcttgaaactcatatgagtcacctagaaagggagttaggacaacttagtaaataagaaaatgttttatttctatgggaaaaaaactgtgtgtcgctttattaggtttgtttaaattatagtataccaggaaaggaggagcttaactgtctttttccccgacataatataccataaacctagtttttccagttacaggatacctgtatttttgcttcccaatgtacaccctatgtgccaccagaattatgtgtgtgctaccttaccaccccgaaaccaaaccaaaccatctggcttttttctgccaggccactcctttataacccagttccttctttgcttaccaggatatatgttgacttaataaattatttctgtgaaaggaaccatacctttttaacctgccaattaaaaacaaattgagtgtatgtattttcccataaaggtaacatggcaggccctgaattagtgttatgtgaaaatgtagcataacagttagacttttcctgtggtaatatccattatattactgaagtgtgaaagcgtatgcatacacaaaacacccttatctaccaagaaaataagaagcttgttatctgcatattagcttttccctctttctcacttgatattgagctaaatccttgccagaaatctagattgtcactggttgtcagtacttcagttgtctttttggcctctacagactccgccagccctctgtctgtttatattcacacaagtatcattcactgtttcattttgaattaatagacatccttgtcaaacatcactttaggggctcatctgtaaatctgcaaattgtttatataatacggacccaggatttttcattcagtctgtacaatttaagcaatggttttgtctttgttagtaatgttactggtattttgggcttatctttcagtgaggactttgggagtggtgaattaaaagatagatttaaatttctttgcgtttaattttggctttgtttttgcatttttgttgctttagtgtttgattatactaattccatagaagaaaaactataatctctggatggaaaaatgcaaatgtattataatgaagtttttgtactggccacaatttttttttttttttgctcttgttgtccaggctggcgtgcaatggcacgatctcggctcactgcaacctacacctcccgggttcaagtggttctcctgcctaagcctcctgagtagctgggactacaggtgtgcgccaccatgcctggctaatttttgtatttttagtagagacggggtttcgccatgttggccaggctggtctcgaactcctgacctcaggtgatctgcccacgttggcctcccaaagtgctgggattacaggcgtgaggcaccgcgcccagcccttgctacacttttataataaattcttagatcaattttaggatgctttggtttgataggttgagaaaagaattggtttataaaaattgacacttaaaattcatggatgtcaagtatgacttagaggttagaaacagataaaatttaaaaaggttaacaggctatatttaaaatctacatatttgtaaaaagtaagaacaatttacaaccatgtgcaagttaaagttttttcaaattagaaattaattgtgacatcataatcttaacctttttgtattttattaatttctttttttaaattgtagtttcagtctgatggaagcaaacaagaagataaagaaaaaacggtaagagactagaaaaatccaataatgtgtctaatgtttgtcttgctacagtatattacaaattttactgtgaacaagctttaatcatctgtatgagtaattgttttataatgtagatgctgattatagtttttggcggcatatgcaaagttatcttttaagattaacattttttcccctgatgttgaaaaaggaagagagataaaagttcctcattcctttgctacccctttcctttcctcaccccattttatgtcttcgatggagaaacataaataagctttgtgaaaagggtgggtgaggaatgggatattgtgtgttatgttattaagaaatggtaattttcccaaggctgttataaatttattgttggttatattaatatagacctcttactgaaataacttttccttctttcttttaggaagttatccttagctgtttgcttagcattactgaccaggtactacttccatctctttctttgatggactgcaatgcttgtatgtctgaggaactatggggaatgtttaaaacatttccatatcagcataggtaaatacatattattttcatgtttttaactattagtaattctagtatattaacctctaagtgtttaacttttcctaattcttcatctcatcgttttttaagatatcgtctgtatggccagtggaagaatgaaacttataacagtcacccacttttagtaaaagttaaagctcaaacaatagacagagccaaatatatcatgaagtaagttttaatttatttttcatattaatctaaattatatctgaatctaatatactttctttcaggtagcttgtctgagcctcagttttgggaaagcctatgtgttgtgaatggtatagctgatttatatactacagatggaatgactgttaactgtggttttagctcattttgactaccaagttaatgttttcatagttgttgtgtttacatatggataaaaatctaatggaaatcctctttaatatgtgcatcatattatgggatgaaggttttgttttttctttttaaggacagcctgctgtggcctttgcttacctttagtgatttgtgcaaggtagtaaaagttctagcaatttccactgctgaaagttaccataatgaatttttttaatctgttaggaagaactaatgaaattatccagaactatctccatagggagtcaacttttgagaaatttcttttttaaaaaaatttgtacacttttattttcatatcattaaaaacataagagtgatgttctacttcccagtagattatttgaagtttaattatgaaaatcatgtacttcagattagtattagtttagatgcttaattgtattgctgtattgcaagtgttttcaacgaggctattgtcagttgtcattccttttttaaattcatggcagtggtatggttattctaattaaaagtagttcgttctcagtttatttagatttaacagtgtgtaatgtctgttaaatgttgtccttgcccagtgatattgtttctggtcacagcctattgggaaaacaggtgtgtgcatgatcacaatctagttgttgtttttttttttttttcctgtgagcctatggattatattgaaacaacctagtataataggtgctgttatacagtatgaataaagtgctatgggaggatagatgagactaaatgatttcacttgggggagttttgtttggcaggagttgatattagatctgaaagagtttctggacttaagagttctccaggtacagtttctagcttaacaacagcagctaatatttagggagctattactgtatgtgccaggcattaaactaagtgctctgcatggattgtttaataatacattaagcatttttaaataccttgaattcatccactgtcactaccactactaccttagttattttatctggtgtattatagttgtatattctcttacctaaaaatcctttggtgactgactttacctgaaggtatatgttaagctttatggcatggtgatataaataagaggtcctccctggtttgtccctccctgcatccaacctcctttcctgccaattctacttccagatgtactgagcctacttatgtcccctaaatgtaccactctctccttagcttctcttcccctgtatatactttttgttccctctgtttgtacaggttttcccttaccttcctttccccctttccatctggtgacctcattcttggagagtgagctccagtgttacttctagtgaaggcttccctagcataaactgccagacacaatcaatctttatttccatcactattctttagcatataatgttatcatacctctaggtaccttgctatgattgttttttgaatagtttatgtgtttacatgatttaagtttcagtaaatataaaaggtataaatacagcaaaaagtctcactccatcctccatctactcagttcttcccctcaaggaaaagtaaccactgtttagtctcttatttatccttccatatattcttatgtatatgcaagccaatacaatatatattatccccctcttatattattattatattaatattgtttttctttgtaaaaatgggacctcactatgttgcccaggctggtcttgaactcctggcctcaagtgatcctcccaccttgacctcccagcgctggagttacagacgtgagctaccacaccccagccaccttttatattatcaatagcatataagtactgttctgttgattgctcttttttagaatattgaaatttaataaatgaatttaaatctgtctccttcactggaccaggcttgagagcaggaactgttactctgttattcatccttgtatttcttatttttttttttttttttgggagatggagttttgcaccgttgcccgggctggagtgctgcagtggcacgatcttggctcactgcaacctccgcctcctgtgttcaagcgattatcctgcctcagcctcccaagtagttgggattacaggcgcctgccaccaagtccagctaattctttgtatttttagtagagacggggtttcaccatgttggccaggctggtctcgaactcctgaccttgtgattcacccgccttggcctcccaaagtggtgggattacaggcgtgagccactgcacgcggcttcatccttatatttctacactgaccttagctaaaaggctgagacacaatcttccttgtatttctaatgcttagtactttgactgtcatcgtaggcattaatatgaatgaatgaataaaaatacaatttactacagaatagtatgtgcagaatttttaatatacttggatttttgttatatttgtaagctataactattttaccaggcttaaacaatatgattttgttactgtttgaagtttttacattgagcatataatgtattaacttattacttgtagaatttcatgagttttgaatactatttaaaacatgagcttgctatagggcatttagtaattctttctacaaatgtttattatgttccatatgctagacactggtagtttgaggggaagacaaagacaagaaaatatttctttaatttttgtttgtttgtccctccagggtgatggaggcagaagggaatggaatgaaaaacagagaaaggaggggttggccttggcaagtagagggaggcacctgaaatattggggttagaaatagggacaggtagtggtaagttggaaatttgaacaaaatactgtatagctaacttttaaaactaatggtctctcttttctatgaaaccaaaactgggatatggagaattggaaagggaagcagttgatgaaacagttttgattgatggggccagttttgtcatgagaaattaattaaagcaagttcgtcacttggagaatggtcacatctcctgaattataaactgaattcataatttacttcattatattttcatcctagaaagcttccttcctgtcacttgtagccttttgaagtctctagatttattatgtaatcatctcaggagaggcatttaagattctgtgtaataattgttttgaactgtaagaattcatagataaaatttgcagaatgctggcaaaaggataatgagcaaaggaagaaataaagaggaaggaaaggagtagaatttagtttcaaaatattgtttaccttgaatatgaaaagcagataactttacatattgagggagtaaagttacataagtttacagataacacagtaactctgttagagtcactgagacagatggcacgagacatttcattgcatgacaccaaatttgatatcttaatccctaaactgatgagtcctcctaaatctgaaataattttgattctttgtaagaagagttttatgtacttgtagagtacattaagagttttactgattattagactattactataaagtggaaatgtgtattttataaatgttaagcatttaatataaaatgttaatatcctctgagagaatccctaaccaaaatagcccaaatcctaccataaaggatgtgatgaatgtagttgtttacatgaatccattttggatatttggggaataattgctttttcccccacgatgatgtaacaaagctatcaacattacaaggaatgttacttaagatgatccgtgccacctttttcttcctccgtaggcgcctaaccaaggaaaatgtgaagccttctggaagacaaattgggaagttgagccacagcaatccaaccattttgtttgattatgtatgttttgaggttaatattattttaagggatttttctttctgttgcctttaaatcagtgcaagtggaaatagaatgatgttagaaaatgaaacattgtaaggttatgctaaaaacaaaattactacacaatatatttaacacattgatctattttaatagtaatatgtaacagtgctactattacaggcaatataatagttattttgtatatataatgttattttgtataccacatcttgatttctggtattacttgattttagacttttagaaacattcaaataacatttcattgtgatttatatgtaatactatcactgcaatatttatttatttatttatttttttgagatgaagtcttgctctattgcccaggctggagtgcagtgacccgatcttggctcaccgcaacctctgcctcccgggttcaagcgattctcctgcctcagcctcccaagtagctgggattacaggcgcatgccactgcacttggctaattttttgtatttttagtagagatgtggtttcaccatgttggccaggctggtcttgaactcctgacctcaggtaatccatccacctcgacctcccaaagtgctaggattataggcgtgagccaccacacctggcccatatttagagatatctaaaacatatgagagagactagactctttcattccaaaattcagctttaggcctggaattatttcctttttaaattaatttttttaagatgcaaggggtacatgtgcaggtttattacatggatgtattgcataatgctgaggtttgggtttctattgaactcctcacccaaatagtgagcatagtacccaataggtagtttttcaaaccttgccccaccccacttaacttttagagtccccagtgtctttctatctttatgtccgtgtgtacccatagtaaagtttcaggatacaaaatcaacatacaaaaatcagtagcatttctatgtaccaataatgttcaagctgaaaaccaaatcaagagcacaatcccatttacaatagccacaaaaaaagtaccaagagatacatctaaccaaggaggtgaaagatttctactagaactataaaacactgttgaaagaaatcatagatgatacaagcaaatggaaagacattccatgctcttggataggaagaatcaatgtagttaaaatgtccataccgcccaaaggaatctacagattcattgcagttccagtcagattaccactgtcattttttatagaattggaattattttctaactgaaaaatgtagcctaagaaaatattctctaaggcagtgataaaatagtaatttctatataaatatgaaatatttatatagaaaccactttgttaaatatttatataggaaaccactttaattataagcattatttcttttgaaaaatagaaagtgtagccattacttagttggcacagtagaaatcctttgatcagttaatgccttctattgtttgttgctgttttccagatcttgtcacaaatacagaagtatgataacttaataacacctgtagtagattcattgaaatacctcacttcactgaattatgatgtcttggcctgtatcctttcaagtgaagtaatatgtagatttcatatttaatagatcatatggtaaacgttttattttcattctattttcctttagtaaccatctgaggttgattcaggtggctgatctgaagtttggtcagtcaattgtgtgtgtgtgtgtgtgtgtgtgtgtatgtgagagagagagagagtgtgtgtgtgtgtgtgtgtgtgtacgtgtgtgtctttgtgttgtataaagggagacatgttaggcttaccaactttttttttttgtgtgtgtgagacagacttttgctctgtctcccaggctggaatgcagtggcactgtctcggctcattgcaacctccgcctcctgggttcaagcgagtctcttgcctcagcttcccaagtagctgggattataggcgtgtgctaccacacctggctaatttccttgtttttagtagaggtgggatttcactaggttggccagggtgatcttgaattcctgacctcaagtgatccacccaccttggcctcccaaagtgctgggattacaggcatgagccactgcacccagttggcttaccaaacatcttgatattgatggaatctgtcttgattgctgaaagatggaaagtaggctaaagaagaaatgttggtactacagtaagtgtatttttcaataattagttttagcaacatccctggtcttggaaaactagaaaaataatttgtaatgaccaacaattttgcccctatgatgtggcatattcatgttttaagggtctttattagagatgtaatgacttagttttttcttaatgtatgaaagattgtatcattgaagctttagctaatccagaaaaggaaagaatgaaacatgatgacacaaccatctcaagctggcttcagagtaagtatttttatttttccaaagatgaaattactatctgtggtaactgccatgttatgcattttattaccgatgcttagagacttttagaagcctatttgttaagagttgctgagaatatctagctactgagtttgttctgcagagcccttggctatgtaaggaggttgatatggtacttatttattttcctaacttaagagaccattattgactgtgatagaatttgggtaagcattactggggaggtgaaatctccttctttttattttatttttttttcgagatggagtctcactctgtcatccaggctggagtgcagtggtgtgatctcgactcactgcagcctccgcctcccaggttctagcaattctcctgcctcagcctcccgagtagctgggattacaggcacgcgccaccacgcccagctaatttttgtattttcgttagaggcagggtttcaccatgttggccaggctggtcttgaactcctgacctcaagtgatccgcccacctcggctcccaaagtgctgggattacaggcatgaaccaccatgcctagccaaaaatctcctttttaactaacattattttataggagttgatcgtaagggatctagtctcatttcttcccattccatcctgaggttccagtcatcttaaaagaacaaaaacttgacttagtttaaccaaaaaaactaaccatatttctttttaattcttgtacctttggtttctagcagccagttccttttctttcaacttattgtatctgatagcggaatcttgcagtggctccccattgtcctttaaagtccgaaatgtttaataagtcatacaagtaagttcttttgaaatcaggtccttttgcactgttctagcctcatcttttccctgcttcccgatattctagattccattaatactgaacttcttgtactttccatgaacttttgcccattattcacttgacttggaatacccttcatggcccactccatgttctgtttattcattagatttcagcttagaggtcacttcctctggaaagctttttctgttaatgctcccacccacaagtctgaattgggcgctcctcttttatattcccatggagccttttgctcatcatagttatttgtttacttttctgtatcttccactagactcagctccttgagggcaggacttgtgttttgtccaatatcatttaggtgcttagcaaatagttgtggaataggctgcagagcacttgactttacttgaatctcctactcttgtattggctggggtctcctccctattcatggtatgataaggaccattggttaaagttggtctcttgtctgcttctaggtctggtaatactttattttcttgcacctccacaactagtagcatgttccaagataaaaagagatttttttttttcttgactcacattcaggggctggcattttgtcatttattcaagtttactgagtgatctgcaagattttgttataacttagtttcacaaactctggaatcaggctgcaaagatttgacttactgctctactttgtactacgtgaccatgagcaagttacatgacatatctgttctgaatttgcctcatcaataggttataccaacctaggataatagttgcaaggattaaatgagataatcattataaagtgcttggtacagtgcttgacatatgtatgctcaataaatattggttattgttattattatgaagctccattcaacagcatcagcaatacaattattgctacctcattttgttttagaggtttagttgaaatgatacttgtgcattttgttttatgagttgtttttactctttttttattttatataggtctggctagtttctgtggtgcagtttttcgtaaatatccaattgatcttgctggtcttcttcagtatgttgccaatcagctaaaggcgggcaaaaggtattcatagcaaattatacataatgaaattcaatagagtacttttggtggtttggggttattgagactctgttatcccgaaagactacttatttgttggttgtaggctcaagtagaatagttgctcacttatttacataaaattctttagttaaatgataacttaatacataaatagacaccttttttcatgaataaatgtactatatgactatatatgttaatgcactaaaaagatactttcagttattttgactgcctattaggcttttgagtaaatggctaatatgatacattgtatatcttcgtataacaaaacatactgcactaggtcagtatgcagtaattgacctgtgtcacattgaacatctggtaggaacttgtttatcttgagggtgtatataatacctttaaagcataatttttgaatttgagttttagagatacataaggctttcataccttttggacaatgtccttttttctttataaatactgaagtttattttattttgggtcaatatcagtgcttagagtttgaattagtatgtatgtgtattaaacctcatgagaagtaaactgactagaatcaaagaacctgaattgttttcagaagctttctggtagaaagcaaacaaacaaaaaattaaaagctacttggtgttccaaacaagtattacctaagtaattattgacagattcttattttggcttagggaaaacttaaaaaaactttaaacttatgattttatgggcacatcccttatgctcatctctctgccatttctatatatttttattcttctttgtctataggccaggagaatatatatcattttttaatctataactcagctttctgtactgtgaatacagtttttgtgaccatctaattaaaacatagtttaaagaaaaaataaactgtttcattggtacttatatactagttttcatgagggctttctttaaaaaaaacaaacgaaactaaggaaagcaaggcaagttgagagaacaaacatttaataagaatcttagaaaatggttctttcgtctattagcttgtgtcttgggtatgtctgactttatgtttggaaaaacatctgtatgttttaggaaagaatgtttttactttgtttagattaattaaagaagatcttagaggacataaggtattatttccattggtagtcctaaactttgcagattaaaaagcataactgttggcacattactgaaatgtgctctgggctggccactaaattgtcatctttggctcagataccacaacttagaacttctttttttccttccttccctgcctcgcttccaagtgtatgtgaccatgctacatctttgtccctgtttagtaaatggattatttagaaatggctctataccatcaaaaacattttggccatcctgtattggaggagaaaaaatgctatgaaggactttattgggtcaactgataaaatgaaatatgaatggtagattaaagtattgtatcagcgttacatgtactaaaattgataactgtgctgtggttatttaagagaatagctctcttaggaaattcagtcttagaaattttaggggtagaaggccatgatgtaaataattttccctcaaatgattaaaaaattgagtgtgtgactatgtatgtagagaggggctccagagagggagagaaaatgcaaataatcaagcaggagtaaaaatgttaccaggtgaagttgaggtaaaggatatatgggtgagctttgtactattgttatttttccatcctatctgtaaatttgcaattatttccaagtaaaagttaaaataaacttacgcaccaagtatttgtcaatatagttctaggaatgcagttaaaaactgcttcagccccttcccccatatttatatacaaataattaagggtttctcagtatattaattacaatacattgttacttttatatttgaagttctaactatagactgtttcttttttctttttgaatagttttgacctgcttatattgaaagaagtggtacaaaaaatggcaggaatagaaattacagaggaaatgacaatggagcaactagaggctatgactggtggagagcagctaaaagctgaggtaagaattgctatttttgttcatcaacttttaaaattcataatgtatgcacggtcatagtaaagaatccaaacaatatgtaagtttataaaaccaaatgtcaaagccatacataccttcctttcacaaccacccctgccccccttttgaaattgagatacagtaattactttaactttttaaaaaagctgaaacaaagtataaaaggcagtaagtaatgcatccgtaaggaaaataattaccaaataaggccgggcgtggtggctcacgcttataatcccaacattttgggaggctgaggtgggtggatcacctgaggtcaggagttcgagaccaacctggccaacatggcaaaaccctgcctctactaaaaatacaaaaaattagccaggtgtagtggtgggtgcctgtaatcccagctacttgggaggctgaggcaggagaattgcttgaacccaggaggcggaggttgcagtgagccaagatctcgccatcgtactccattctgggcaagacagtgagatgctgtctcaaaaaataaataataaataaataaataaaataatcaccaaataattactatatcttctatgatccttgatatcctcactcccttaagtcttagttgctctgttgaatctgtgccatactgaataatgaataatcctttatgaggggactgcaaggtggaaaatggaaaatatgcagaaatttaaattcagttgacatttgtctttaagccagtgactgtagtcagtaatagtcactgaaataaatttgtgtaagggaaggaatgtggaatgtaggagttttttatattaagcattttaactcaacttttttctgtgtctttttcaaattagcatgggttatgtactgtacactggtaaatttgtgtcttcccttgtgcagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccaggcaagttaaagtggcttttatgtttatgtacatgtttttaatcctgttaaaggaggataatgtgttataatttgaaaaatgtcatttttgcacatcatttgaatatgagacatcctaatgtgaaagacattctggaaatagggcctatttctatgtaaattgtgatatataagagatagctccaagagatgttatatgtaaggctgtcaattaattaaatattacatcattaaattcctgcaacttcaagttgtttgcatttatatctttcccgatctctggaaatctcagtcataacagaatagatgcttgcttgcccacttgtgcatgctcactctcttttccctttttttttttttttttttttttttgagacaaagcctcactctgttacccaggctagagtgcagtgcatgatctcagctcactgtagccttgacctccctggctcaagtgatcagtctacctcagcctcccgagtagctggggattataggcatgcaccaccacacctggctaatttttagattttttttgtagagtcgggcctctgccgtgttgcccaggctgggttgctgtctctctttttctttgtgttatagttgatgatagttaaacacattttgtgggctaatcttaggttttggtacttaatatttataaatatattctgtaaataaagttttcttcttttaagggcaaaggaattgacttctgtttgcctatggttattattttatttgatttaggtaaatatattctactaaaagtgatgaacaacagcttgacatttaagagacctagttggctagtaaaaccttggattagtcaacctgtcagggccttggcatctttttttgtaatatggtcatgtggttatacttgtagatagtctctaaagtccttttaagttataaaatttggattcttaattgttaaaatattcctaaaatgacttcttaatcactttggaaaatatgttgattttgtcttattttttaaatttagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcggtaagtacaagtgtctttgctgccgctcaagaacgatccaaattatttcttaacggttttatctgtaagtacatatcactacagattttgggggaaggtcttggccctaaactaggatcccttctttgtttccaataggggtacgaagctgtgtggtagaggtatacaaaaaaggtgatgagaaatttggagtctaattgatcatttaatcaaacatctgctgttagtgtttacatatcaactgctacagtctcccacttctttcctaactaactgctacttgatttaattatcactttgttagcactatgcagaaattcctgtgttatgtatacactctgaagggaaaaagacaataagggagtggtgttaggctgcttcttcccctttagatcctctcaatccagagaattgtttgccgtctttgtgtaacgtcttactgttgtcacaccccatggtagatcagtctcagctgtgcaagagggtacctgatttcttgacagacagaggtgggagaatttcttcatcttaggaattctgacctgccctgtgctaagtgaacacactaatcagcaatatggaatcctagcaaacaggaacacctggttgtctgtggttggctgaacttttccagctcagaaaatggagcaggtcattcaagctactttttctctcttacttgtgtaaaatattacctttgtcttttaagagatacaaaaacctaaacaaagaaatggcatttccctctcaggcttggaagaaaacagaaaactaaatgaaagtggctgtatagccaagtcagatataagtcttttatctgtaggcagcatgccactctctggaaaaggtgtttcccagcaatcttgtggttgtgctggatgggcatccaagctgtcctggggatccttgcttttgcttcttgagtgaaagcctctgttgaagagccttcgttgagagagtgaaaatgtatattaggtgattgctatgtcccctctataaactatcagcaggctctcttgaggataattcagccaaacgctgcccagattttttttttttttttttttttttttttgagatggagtctcgctctgtcttccaggctggagtgcagtggcgcaatctcagctcactgcaacttccacctcccgggttcaagcgatactcctatcccaggctcccaagtagctgggattacaggtgcccgccaccacacccagctaatttttgtatttttagaagagatgagatttcaccatgttggccaggctggtctcaaactcctgacctcaggtgatccgcctgccttggcctcccaaagtgctggcattataggcatgagccactgtgcctggcctgctcagattcttgagacgagatttttgaacaatagtgagaagtacagcaataattgtggatatcagttctattccataagtctagttccccaggcaatttgaaatgtagaactgttatgtctcttcatttgactgaaggtgtgaacttgaagtgggagttaaactgactttagacaaggacatattcatcttgggtaaatacgaagtatagccttcttttctgaccaagcctatttttctaactagatagtgactatggggttcctagcaatagaaatcacagattcagacccagaggactggggagattggagctatcatgtaaccctctcatacctataaactaatttttagttttaattgttgaggttgtggtccaccttgagacacaggtctgaaagataggcttttaacctagttcatattctagatcttgcccagaacaggtaattaggctgtcttttatgcagataatgtcagccctattttatcccgttttgttagaaccttagcagaagtcattctgctcatctagattcatattagttaccttcaataagacctgtcctctaaattaaaaaacactctctgttttcccaactgctattccctcaggtttctgatgcaattgggactcctttttcgtaactaatgttctttgtagctttgtcacttacgtggtctcagtggttgtcagcatgctctctaaaatggggataacagagcataaatcttcccacttctagaacaattgtaaaattctagaacaattgtaaaattgagcactcaggaaggaaggcaggtaactgagctgtaaggagctgagactcttttgcctatcacagtgtagaactggaagcagaacctttgatcatctcgttttgggttacgtgtttagcacaaatagaatgatttaagtgattttctaacgtaaggaagtaactagttttaggacttcctttaggttcgtatgaagggtgatacctaacttaaacaaaattttctggatgagagctctttcatcctaaagagactgaaggatgtgaaacaatagcagcaactctgtgttatcttcatatatatgtgtgtgtgtgtgtgtgtgtgtgtgtgtgtgtgtgtgtgttcatgtataatatatatgttcatatatatgttatcttcatatatatagaatatatagaaaaaatatatatatttttgtgtgtgtatatatatgtataatatatttggcatacacatctctgcagcccctcccattgtactaacaattttttttcctcatacaattaagaatatggcattcctctgttttttcccccaaattaggataaaccagtcaaacgaaagaagctgcagcatcagttctcacatgctttaaacttcaatataccacagcttttcacagaaaaatttatttggcttagcagtagagtaaccagttggtcctggtttgcctgggatgttcccagttttagcactgaagtcttaaatcctcagaaatccctgaatccccagcaaaccctgacaattggtcaccctacttagcagtcttaaaacaaatttctcataacttttcttagtgttgatccagctttttttttttttttaatttttattttttgagacagtctccttctgtcatccagtctggagtgaaggggcatgatctcagctcactgcaacttctgcctctggggttcaagtgatcctctcacctcagcctcccaagtagctgggattacaggcctgcgccaccacgcctggctaattttttgtagagatggggttttgacatgctggccaggctggtctcaaactcctgatctcaagtgatctgcccgccttggtctcttgatccagctttttaattgacaaattttaacagttggtagggtctgcatgtagtgatactacattctgtcctagttggctattactagttccattcttcctcttttctcatgttaagaccttctatttgttcccttgaatatctcaaaagcaggactggaaaccctacatgttcaatccctgatacagcagcaagagggagtagggtgggggaatgaaagaggagaacatgcatataccctgttcactttactcaacaggtcagattagataagaaccctctgagaatctcctagttggcacacagtactaaagactggaatagcttccagagatgatttatcttaaaataaacgttgttcataagaaactagaatttctacaacagttttgagattggtcatcttttgattctttagaagggaatatagatttttatgccatgaaagtcaaagctataaattatgttgtgtgtgtatgtatgtatgtatttttactttttatctacagtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatggtaggtttttgttctagtagttcaagtgcaataactttatggtattcaatgttacctatattttgaaattgttttagctctggttccttaaaacagtgatcttgttgctatataatattttcttaaatggggtttaatagttacttctgagtggggggccaggagtttggtgactaggtggaggttatgattaatcaaaaattatttgagtgtccttttctactgacgactatgctagtaacttaaagtgattcatgtgactctaatagcaagagcagtagttctcaagaggagagttctttaggagaagactattgagaagccgagtcttgaaatggacaggccttgaaggtagattaggtttggaaatatggaagcagatagggaggtcaccatagggttccagcaaagacaggaagtagattgaggtttagggagaccacttttactgattcactttcatgtagtgaatgtacttagtgattcatatgaatagttatgatggggccagattatgtaggcattggaagtcagggagaaaagtagacttggtaaaattgagagctattttagattcctgagcaggatagtaatgtaaaaaatggtacttaaaaaagattactcatgacagcagtatgaaagatgctttttgactagcattaggctaaagaccagctaggtggctttttgggcagtctattgtgagagcatagactgatggaggtagtggcagtgtacaaggcttgtaaaccagtcttgatataaaggagagggaagagtcaaagatgacaccatgcctgagactaatagtgtcagtgttgcaaatgtagcctgttctgatggtgtatgaagatgccatgacagtgttatgagtgtgttgaatggagataaaagtagcacgttcaagtggacctatattcatgttaaagtagttataaactatcagcctttatctctttaaacttttcaattaaaagaagaaaggtaatgtgcatatagttagaaaagtgtctaattgaattctttgtagcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaagtaagttgttggaattgttaggttcctgatgctggtaaattacagaaaacaaaacattataactttagaggtgttaaagtgtattatgtttgtatttcaactcagtgttccctatcccattctttggttatttgttaatgcagaatcaacttcatgttcactggaggaactgatatagtttgctggtgaagttaattaacttttaactacatattggcagcttgtcattcagcttttctgtataaaacatatttctggagaaatcatagaaaaaaaggtccacatagtaaaaatgataatcatgaccaggcatgacatttggttacaaactataaatagtttgtggtttatagtattctcttcactaaaggtaatatgttgtcatgtttagtggctttgaggcacttggggaagaagtttaccacttaatatattcttcctttatttttagaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagtaagtttttattgcaacctttaaaaagttctcacacaaagatagctaacattataatttatagaggtattattgtgtgtttagttaaaaagcatgaactcaagaaccaagtgtctgaacttgaatcctagctctactactttctagctgtatgatctttggcaagttatttaacctctctgtgcctgttttcttatctgtaaagcataagtacctgcttcataagattgttgtgaggattaaatgaatcactacacataaaaagtacctgatatgtaataggcactcaaggttaaactattaactaagtatttgagtttacgtgttgtatcataataggtagaactctcttctccattcttaaccttcacttctcaaaaaaaaaaaaaaagacaaaaaagtttacaccttcacacacatataaaagcagggaagcttttcagtatggtcatatgcacattttgcatttagcttttttcttattactacattttgtggtttaaaaacataatgtggccgggtgcggtggctcatgcctgtaatcccagtacttcgggaggccgaggcgggtggatcacaaggtcaggagatcgagaccatcctggctaacatggtgaaaccccgtctctactaaaaaaaaaaatacaaaaaaattagccgggtgtggtggtgggtgcctgtagtcccagctactcaggaggctgaggcaggagaatggtgtgaacctgagacgcggagcttgcagtgagcctagatcacaccacggccctccagcctgggtgacagagtaagactcagtctcaaaacaaaacaaaacaaaacaaaaaacataatgtatgttccagtatgtcagctgcatatttttaatttctatcagcatttcctctgcttactctccccgtaaacccagtaatatgtatggctaagtggttaagaaactattatgtaataaaaaaaaaacaacttattatgtaataataatgataaatttttttttccttgtcactgtaaatcagctttctttataaaagttcttgttttgggtggttgttttatgaatgcattatttccccacaaaagccaaaatctccaaagttctctgcagtgtcattatataaagggaatatacattttgactaggcttacctgtttattatgacttgctgtaagagaatcttctaatatttttaactgattttgaccttgatttgtttatattttttaaacatttttctcctgtaggttttctctgacataatttacacagttgcaagctgtactgaaaatgaagccagtcgatacggaaggtttctttgctgcatgttagagactgtgaccaggtggcatagtgatagagccacatatgaaaaggtatgactaataaaaacccttatattttacccatgtatataatgaccacatccattaatatctagatagttgagttttaaaagagaagctgagtttaagattcagttgtaaaactgtgtttataagcacaattaatttgttattaaaatgtgctatgtacttttttattctatctcaaactgacattccaaattagtatctttgtataagttgaactttttgtgactacctatccaaatacgcatgatgtttttacacggaaacattgatctagtctacttaagtttcaatttctgctattttgtggatcataatttttctttaaaagtgacaaacattgtttccttaggaatgtggaaactatccaggattccttaccatattacgggcaactggatttgatggtggaaataaggctgatcaattagactatgaaaattttcgacatgttgtacataaatggcattacaaactaaccaaggtaaaaaaaaaattggatttttcaaaggcaaatttttctctgtatacttgtgcttttataataatggatctgaaaatgtttgttgtaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatggggtaacaaaattatattttaatgtgatttacaagactagatgacagaaggattctgaagactttaaaatgttttacagtgttgaagtttatcttctgccttcaggagattatgggagattatgcgatcatgtttccacaggctggtgagagttaccacttctgattatcaacttccggtctatactggatgatagtttttttaaagtcatgtataatatttcttgattgggaggaaatataattttatcatcatagttaacagatcttcaagagtaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactggtatgcttatttgtagaaacttataagtaatatattttatttcaacaaagtgaaatgttttgtatcacagaacgagtacaatgctggcttagtattactttttattccctagataggagtatataagcgttaagaagtaatcagcttgctgtttctttctaattattctctaatcattttgctctgaaattgtagcttatttacatttaggggcttgttaaataaaaccttacttttatttcagataaatcaagggagagatctcagtgtggtgtgaaagctgttaataaagcttctagtaccacacctaaagggaattcaagcaatggaaatagtggctctaacaggtaggaacactgtgccatgtgtcataattctaaattctttttaaaaatgatttttatgtatttttttgagacggggttggtcttgcaatgttgcccaggctggtctcgaacttctggcctcaagcgatccacctgccttggctttccacactgctggaattagaggcatgagccactgcacctggccctcataattctaaattcttctatgagtcctcatgagtagaaggggagtggttgttgagtaatgtgaaaagtcatttatgttgggctttgaaattttgtatgtaccctattttgctgatacgctttacatcctaattatgttttgtatagttatgcttgtataacgactttgtttctccttctgggatattcaggggaatgtaggtgtgaagttaaacaaatattttaggatagagggattgctgtgggttgaagcgattcttgtgcttcagcctccctagtagctgggattacaagcgtgtgccaccactcccggctaattttttgtgtgtttttagtagagacagggttttgccatgttgaccaggctggtctcaaactcctggcctcacgtgatttgcctgctttggcctcccaaagtgctggattataggtgtgagccaccgtgcccggctaatacatcttttaaatctgcaattaatgaatttgtttatgatttactggataaagaaatacttccttttttcgagaaggagtcttgctctgtcacccaggctggagtgcagtggtgtgattttggctcactgcaacctctgcctcccaggttcaagtgattctcttgcctcagcctccagagtagctgggattacaggtgcccgccaccatgcgcagctaagttttttgtatttttagtagagacggggtttcaccatgttgaccaggctggtctcgaactcctgacctcaagtgatccaccctcctcagcctcccagagtgctgggattacaggcgtgagccactgcacccgaccattacttcttcctttttccttgtcttaaagttgtcctttagttttcaaaggactcccccttagttctagtatttttgaagttagtaagaaaccctttatgatatattttatcatatatcaaaggatatattttatgattatttgtgttaaaatcccatgtttttattcttaagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaaggggcaagtttacctttctttatacgttcttacgttttgttattttaatgtatagttggttattgtctccttgttttggtaagttatataggggttttgctaggggaacttgtcatacaagttggtgtttttttttaagtgtttggaaaactagaaatgtaccttattctgactatttctttttgtcttaacagaacaaaaacgccgcaaaattgatactcacccttctccatcacattcctccacagtaaaggttagtatagcctgaggaaggcagcgtccatgttaggctcacctgtttggaataccagtgtcctgacttccttcaagtcttatgccaagcattcactggagccactggaggttttatattgcattagaaaatgaatttttctatattggtggactgattttttttcctattgagtatttttattataaaaatgttaaaacttcaaggacttagcactaattttgtagtgtttcaaagtgcaagagaaattttacccagaagtgcctcaactgctttaagcagtcttttttggagtgcaatggtagctacaagcaaacgaatcttttcagcagaatgaagcctatttttcagcatattgaagaatatatagcactgaagacttcctggatgacacaagataaacaagttacctctgaattcaagcttcttgatgagcatcataccgatgtgtgccttctaagaaggagtcttgaaaggagttccattttaaagtctccttggtgatcagttctcctgtagttgtgtatattcagtgagcatgcagcttctgttgtatcttcccttggaggtttgtttatacccattgggttcccaacaagttgaaccttgcgttacgataaaagcagatgtggcatccaatcctaccacccagcaaagagaaaccccaggcattcaactgcagcacaaaatcgtgggtgtagccttcttgaagactcagggtagccattccttgctccatatttaattttaattctaaagtcatctaatttcatggaatctttgaatttgcagtacgttgaacttttaaaaaactgtaagttattaattgttcatcaagagcactgtggtggaatatcgtagttgatttctttttctttctttttttttaatgctttctttgtgtgtgggaggtgtgagattcaccatgataggcactttgcagaaaaaaaaagtgattactcttatatattttgttttcttgttaatacaatgccactgaatttttcagctaggatgtgtatattcatattagagttaaaaataaagtaaaatgtgaatcctcccaattaaagaagaactatgaaaaatataaggcaatgttgttcttccacagtgacctccagtattttaaattttttgtggagaaaaaaatgttttgctttcttaaacctcttaactatagcttaagtagagagatatgaacaatgtggcattgacatttatttttaaattctgagcagagaaagatttttatttcttacattgagtacatttaatttagtttttaacattccaattccattacatgtttttttttattgttgatattcatattgataatgacatcatgaaatttatcctcacaagaagtagctggtttatttccaggttacagccatacttcccaaagttcctctgggttctgagaactatgccagctcacctgtcatctccattcattttctacaggacagtctcatcgaactcaaggaatcttcagcaaaggtttgagtcttttaaaatcatcatgcctaagtaaaccaaatgttctttacttattttatttagtagatgtcctcaccctagtacattcagtaagctgagatcagtgggataaagtactctgcttacattgaataaccttcaaaaatattaaatgttaaaactgaaacaacagatgacagtggtcccttttaatgagattgttataaaatgtgtgtaatgtggcaacatttctatcatctctccttgcttgctgtgttataccttctccttttatgctttttcaaaatctggaaataagtttaacattcggggaagaggttatttgattgttttgggtttatttaatttttcaaaacaaatctgccaggctgtctgactgtttagacaacccaaaataccaaaaaataaatttgatgcattcacatatctgttttaaaaatggaactcatctcaatctataaaaattctttatatatcctctgctgaggtacctttttggtagttacagcacaatatcaggagatactgttaatgtgaaagaatcattcccctggacaggaatactcggtggttgtgtttacatgtcagtattaattcttacctattattctactttcttgagtattctgctactaaaagtagtgtgcagtttgtgtatcttattacagagtttatttcagtattatacttgaattgtccattgttcatgttgttttgtctttgttataaaacgtgtacccttctttgattttctactttgcctcctcttacaagctacaagcaaatgaatctgctcagcagaatgaagcctatttttcagcataaatattgcttgccatgattaaaatagaaatcagctaagcatgatttctttactggtggaccaaatgaaattttgaaacagagccagttgacattactaactgcttttagatgtatagatttataatgaaatgtctgtggatattgggcaaataaggcactaatttttaagtttatattagccagtgtacctgtgtcctaaaattgtagcattgttttttagaatatactatattaatcaaaagtctcagctatgctgggagaagttccatttagttttattttttttctgatttgaatggatgttttatttgaagtagatatcggggttattctgtaatacgctattgaagaacaagccgaaataacacattagacacaacatcaacctaatgacattatttttgaaaattctaaacgtccaacgtatttttgtttttttgctgttagccataacgtcacaatactaacagagttctccatacctagtaggagttacaaaaatgttgatatcaggttggaattatataccgctatttattattacatgggattattatttaaaatgatgttcctatttaggttagttttggaaaacttaatttatattccatttcaattttgatatctatagaactttcatttaatgtaaactttttattggctaacttaaatatatactgcaatatagtaggtttttataaccagtttcaaattgtttatgtcagtcttaaccatcagtggcttctatgggctattttaaattaatgggctaacagtgttaacttctgaatatttgtttactgaaacatactttgaagcagtttgtaacctgctgttaaaattaactggattttctaatcgatgatggttcctcacatttgtgaaaaggccttttgaatatatgtactatctcatttcatgctcataacagtgctgtgaggtagacagggcaggtggatagtgtctttttgacaaatgagagactaaaagttctttagctttcccagttacatagaatttgttagtatcaaaacatgaactaaaattaaggtttcttgattcctagcaccacccatttcaacaatagttgagagggtttttctagctcctttagtgtgcttgccttggtttttaaaaattacagtgattcaagtcagtctcccacatccctcctttttaaaaatggtgttttgcaggcctttaaaatttaattaatttattccacatgcaaccagaaaaatttgaaaatggcatatacatatgcttctaaaaactgtgtgactcctactacttttcagatctttagtgcttagcatggtgcctggcagtaaggttaggtattcaataaatacttgaagtgatctcttaagcctttgcactttggtaaagcatgcaaagtactggtttgcatagtagctgatgttgcatttttatgtgtctagaaagtttaatagcatatgaatgtcttagaaaaaaaatttcactggactttgagtgatctccaaagttgattatctttagcctgtttctgaggtagcttttactttctagagggtttggaagatacgcatctattttcatattatcttgtcacttgtacctataaaattctctccctgctttagtttgactttttagttatgcgttttctgtgggattctctttattatttatttgctatttttactttctaatttgtggtaaaagcaatacatggattttagcttttcaaatgagattaactaaaagaagaaaaatctagcttagtatccaaatcttttctgtcagttcaccctttacccctaatttccaaatagtgtatttctagttttgatcaattgtgttttgatgtagcaattctagcagctacttttgatgaagatagtgttaaaaaaaaaaaaacaaaaaacaggttccattaatcagcctctctctaatttaggagggcatcagtaaccacctcaagacagaatttagctttcaatttgttcaccatcttaaaatgaggatttacagccaaacccaagcctaaaagtgaggccatctttatataatatagtgaagctttaataaagtcagtggagcagagttttctgaaacagattttgaaaatcagtcaaattcttttttggaccttaatgatccgaatgtcaagaataaaagccaatcaagaacaaaacccagcgatgctacatacaaatccatttaatgaatccttaattttatttgtcaaacttgtattgagtattcactgtgtgtacaaggaactaggaagtatgtaaaagtagaaaggcaccttagctcttctaccatactggaaactgttatggacaaaaatgtatgacatgaagttaatagggagcacttgtcctaaaaaaaaggtaaatataaaataatgtaaagtgagttgcagagttgagggatggttgagtgctgttgactttggccatctttgaaggctaagtaggattttaagaagttaagataaaaatgaacaaccattctagtaatgagaactgctggaaaggacagatgttagggagcagtgatagccacagcatagaatgcattgggttactatagcaggatataattgtgaaaagatggtggagagtttggaatgcctaaactaaggggtatgcatttaattcattaggcaatgagaaactctgtttttatgcaaaagagtatttgatcagaactattctaaagaaggaattgaattgggtacattctgaactaagaatttctgattgtcagttgagctatgtgactttttatgtcaagaatgaagtatttgaacattaatgccagaagtaagttctagaaaaatttctcaattcctcacagtacagaaagtaagcacagttcaaaacttcattattaataagggttgtgtgtgtgtgtgtgtgtgtgtgtatttttttttttgcttttattgggaaaaattactacttagagaagtcttctttgagtattgcagcaatatttcctttgtcttaatcattttcataaataatgttaagatatgaataaacctcacgattagaaaaatcttgatgtcatttaaggcattctagccagcaagagtatcttttagacaagtatttttatgactatcgttctcttgctctttattaataagcattttgtctatttcagtttatcaacttttaaacattgaaattttaaagaatctacttctgcattgctatggcagtatttctgagccaactgaattgaaaatgtttggtggtgttaaaaaataagtgtttaattctcaaactgatggttttcatttttcatgtattcctttgaataccaaaggatttcttcatgtaaaaatatttgacttttgactcactattctatttgttcctaaggtgtatctagcattgtgtagttatgtaatgagttatattcagtattctgctgcataatacttttaatgtcttaaattaaacataggcttgtagcacagatataaatgccgtaaggttaggtatctgattatttcctgactacttcctaaatattttatgttacagcatatttccatatttacaactcacctaagaagggttatctctcaattatttagttagaatatccttgatgattggctgttttattgcgtatagcccttttggcagagaaagaataggcagaggagaatattggttcattattttttagtcttttgaattgtttagtcatcctcagctgactagatggctttctgaggtatttagaaccaggaagacaaatttcacagttaattgtgattattttgatagaaattggagtgctttcagaagtagagaacatgcagcctttacatttgtaaaaataatttgagataatctttgcatggttcacactgaggcagaaaagaattattagcaaaatcatagctaggttttatttttatacttttgcccattgccattattgactgcctatcggtggatggtaagactatttaaaatttccatgattgtgtagaggtgtttttttctttttctttttttttttaaacagtagagaaactccagtcactattgttcatatatggactcttgtaatggtggttataggtctttacaatagagctataaggaatactctagcttgtgaatttactaatgagtctcagttgaggcacaaatgaactgatggagtttaaatggtgatttttataaggccaagaattgaagcctttgtataatttgtgccatgcccttttattttacctcttgtaatccagatagctgaccagtttttactttgggtataattcccaattgtgtttcatttagtaaacaaacaagtgatgccaatactggaaaactaataatctttagtaatattgccttaatttaacagctctacattaatcatactcctccaccactgtccaagagtaaggagagagaaatggacaagaaagatttggacaagtcaagggaaagatccagagaaagagagaaaaaagatgaaaaggacaggaaagagcggaaaagggtttgtaaaattttttttaaactagtttggaaagctcattatcatgtacaccagtgtgtatgttgccttttaaaaaatactagtttgttccatagtagtctgttatttcatgattttattgatatttttaccctgaagtgtttgcattttctacgttaataaggatcttcagcctagtaatctctgtcagctctgcttgtctttcatgccattttaccaagtatgtgaaactactgcaaatactctccattgctagttagctgtgcccttctcatataaaagtaatactttaaaacaaaaacagaagcccttggtcaatgtagttcacaattcttggttctaggatcactcaaacaacgaccgtgaagtgccaccggacttaaccaagagacgtaaagaggagaatggaacaagtaggtagacttattcatatctttgaagatatcatcgaagtgaattggaaaaggctttcatgattttcttttgtaattttagtgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggtaaattaggaaaataaaggaataatatgctttatcttaaaaaaatcaatcctgaaaatttagcaaatattgaatttttttcctagtcctatagtcttttgttcattatttaggagtgggaagaagaggtattgagggagggcattccgtttggggaatttgagtcagttcagtcccagattaccaggagggtagagttagtatacctctgagattcctttcccctctccattccattcccacctacttctgttgattgagtttcagctgttctttgcattttcttttttctccaccaactctttgcttttagtttctctttattcctgagattaaaatatggtcacatgtattctctctgaccatcatagcatcataaagtcttgattgtgatttgaaacatttttgtaacgttttctcctaataaactcatttgtttgatacttgtatttgatttaaaaattgagtataagatacattctcttacatattaatggttgatatttaaagtgaatctcacgcatctgccataaagtaataagcaagccattactaaagtataaattgtttccaaaacattgttatatatattgaaaatatatgccatttattcatagttcataaaaacagctctagaaaattatataatgaacattttaattctatgctttaaaagataggctgttcttttaggtgttttttaattgaggtaaaattcaaataacataaaattaatcattttacaggtgtacatttaagtgacatttagtatattcacagtattgtgtaatcatctctatctagttccaaaacatttttatcacctccaagagaaaactctatacccatttaaacagtcactcccatttccccttctcagcccctgggaaccataaatctgttttctttatggattcactcattctgaatattttatataaatgaaatagtacaataatgtgcccttttgtgtctgatgtctttcacttagcataatgtttttgaagttcttccatgttgtagcatgtgtcatttacttcatttctttttatagctaagtaatatttcattatatgaatataccacatttgtttatccatttttcagttgatggacttttgaattgtttccacgttttggctattgtgaatagtgctgctgtgaacatttgtgtggggctataagtatttgttcaaacacctatttttaattatcttggatatatgcccaagaatggaatttctgggttatatggtaattctatgtttaactttttgaggaaccaccaaaatcttttagacagtggctgtacagtttacatttctaccaacaaagtatcagagtgcagatttctctacatctttgtcaacactggttattttctgtttttgttttttattatagccattccagtaagtgtgaagtggtgtctcattgtggttttgatttgcattttcttaataactaatgatgctgaacatcttttcatgtgcttattggccatttgtttatctttcaagaaatctgttcagataccttgaccattttttattttgagggtttgtgtttttgttgctcagttgtaagagttctttatgtactttggatactagatccttatgagataggtgatttgcaaattttttctccagttctataggttgtcttttcactttcttgatagtgttctttgatgcatgaatgtttttacttttgatgaagttcaatgtatctatttttttccttttgttgcttatgcttttggtgtcatgttaagtaagtttttgaagacaaatatagctcgcgggtgatgaaaaggggttttgagctggcttttatatttggctttcccttccccagctaattctactatttcttataggagtccaggcatgataaagaaaagatagaaaagaaagagaaacgggacagttcaggaggaaaggaagagaagaaacaatatccttttcattttgatgttttcagttagtgtagtagaaagctttgatactggtcatgtttacaattgtactcttttagtatgtggtttatatgcttaagggctgattagttttgaaatggtctttccagttaactctcaaaatgtgtgaaatctggaagtgggatacttgatgttcttgatatttaaaaatacttctgtggtgactgagatgttttatgccactaagggatttatagtctttcaggttatattatcacagagaggaagaaagggaacagagagtccctagggctggggacattgggaatagaagggcaaaatgatgagtcagacaagcagagctggtagagtttgaggctaccaggctggtcagagcccatttaggcctgcaacctgaggtgctgtactaaaaggggagatgctgttctttccgccattcccaaaagttgttttcccttaatttgtcatctactcataagtcctcggacaagcacagataatgaagactttccatcaaggtgagtgttctctcaccaccttttcacttaatgatagaaacataaaatgagttctgataatgttgaaaaactagatgcattttacaagctacaactacttgtttttttcacctaaatataacgaccaagtcttcgggtatagatgcaaaacaagattcagagttatttttaagctgttttcattttaagcttgctgattagccacacattttttttttaagcaccaagatatatttaagaacatctggctttctcttcaccacttattcccatcttctctggataattaattatgtttttaaagtccttattgccttgtaaatggtggtagtggtatctgcattttataagtgaagaaacagactctgagaggttaagttgaagagggtcataaagatattagtcaacagagccagttgactatcctcagtctttctatcctttagtgttctctgttccttttgctttctcatgctgatgtcttatccaaagatttttaagttttcgtgccattttttttttttttaccactgcccatgttttgcaacagaaaatatggtctgtgtttttagttctggaatttacaatgtgtaactttttttttctttttttttctttttttaggtaatgcacttaatgctttatgtgagatttaaaaagtattttacccatcttaaataaattgtgtttccatcatagtggatacagtgttcagaccct

SEQ ID NO: 1218 - DNA, 112904 bp, mus musculus
tgacccttcgctcgcgtgctacacatccgggcttctgctactagtgagaggaagatggcggccgcggctgtggtggttcccgcagagtggataaagaactgggagaaatcagggagaggcgaattgtgagtgttcgggccggaggcaggcgcactgccgggccgggccagggcgtcagctgcactctcacctgtagtgggaggttgagggggaaagatgtaccccctcccccacccgggcggcgggcgtggatggtcgtctaggagtttcgaactcggggagaggtgctgtttaccgccgcggacctccttccttccctggcctcccagaaatcgctactgcctgcggtagctcggcttcctttagcctcttagtagaactcttattccgcccctgcaggtctccgcgctccctcttggtctctttttgtgtccccctcttcgcttgatctcacttggctcctttatctttatggggctgagccggggcaattcggactttccatctctctctgtgccatttcttcactctgcacccgttggactccgcagtttggagcttggcgcctcctctgcctgaagtccaaggagggcgaaccgtcccggattcccctcccctcctcttcgcccgctgccgcgaagcccggggcgccgcgaagaacccggtttggcacctctcgccctcccggggagcggtctctcgactgtcccggcctcgcgtagcgccgtggggaagtgtggcagggattgccgctttccctgaagaaccaccgacatttctttgctccgtcttttcaccttagagctatttcgggttggattcaactttcgtcattaaatgttccctaaaccccattttatcctgggactgcaactaattctggcagctctccaagcttctccagtacctaggataacgcgtttcctttagtcgtgaaactttcccccgtaacaccgaaaacagtaatttgccatacccctagtcttctcgcccccacgttagagcgctccctcctccccttcccctggaaggagtcgtttaagcagcaaagcaaacctcagatataagaacaaatattaataacatctcatttccttctctgggtcgcttttagatgctaaagctcaaccctggatgaaattaaccctcgttagccatttttgtcgtccttgcccacccctctccatttctagtagccagtttaccgtggctcatgctaaagattcaaatctttgtaacttcgttacttggaacgaaacacgaggaacgcgttgccggatcccgcgcttgtaatagtgccagcctatgtggcttcctcccccgcaccccccgcactgctgtatgaagtcttaacagtgtgagctctagaattccctaaataagcggctgtcttagccacttaagtagctgagtgaccttgggtaagttccttaaccacttggactgtttccccttgagtaaattgggaataataagtactctactcaaaggattgttgtgaagactaaataatgcctgtaaagcacttggcttatagtaagtgctcaagtgatagctattaaaagtaatattattccaacctttagatatttaaacttctcaggacagctcatgcacttaaagtctgtaccactcaggttagcaattaattggtctctgacttattcatgtgtgtttattcttgcactgtaatgaattgggaggcctttgaaatatagggactatgtctcatatttcttttggtttaacacatgccccgcccccccagcctatgcttagaatgcttattggtttattaattgtcagagaaggctatttgataaatcttcgtttttaactataatgaacattttacaaatcctcgtatgtgctagttaacaaatagctgtcaagtttgatagctagttgacaaatagccatcaagtttggggaaggcaagatgggaagttacccagccagaccatcatcttcatcgatattagggtaatcccccaaaactgataaaagcagttcattgttttgtttactttcaaagccagctcatttatttaggggctgttatgtttgtagattgctcagcttcctcctttcagctactgttttttgacagttttacttttttttttcccccttgagacggagtctcgctctgtcgcccaggctggagtgcagtggcgcgatctcggctcaccgtaacctccgcctcccacgttcaagcgattctcctgtctcagcctcctgagtagctgggactacaggcgcgtgctaccacgcccggctaattttttgtatttttactagacacggagtttcaccgtgttatccaggatggtctccatctcctgacctggtgatccgcccacctcggcctcccaacagttttactattattgctgccaccttagcatgagtggtattagggctataaggtgaaattctgcttggcttctgactggtaatggtttgagaaaaagtgatgtaggagatcgaaatacttagataaaatggaattttaggttcacattatgtatatttacataatacatgctatctgtcatagttcttatgtttgaagagctgcttaaaaactgttattagaagccgagcgtggtggctcacgcctgtaatcccagcaaattgggaggccgaggcgggtggatcacctgaggtcaggagttccagacaagcctgaccaacatggagaaaccccatctctactaaaagtacaaaatttgccgagcgtggtggcacatgcctgtaatcccagctactcaggaggctgaggcgggagaatcgcttgaatctgggaggcggaagttgcggtgagcggagatcgcgctgttgcactccagcatgggtaacaagagcgaaactctttaaaaaaaaaaaaaaaacaaaaacccaaacaaaaacaaaccaaaaacaacagcaaaaaaacctgttattagaacttacgtgtatgtagttattgcatgacttgtggaatgtggattgaattatagtagatccaaatcagtatagtcagttttatgattgcattctgttacaggaagagaatttaaaattgtgtaacataataagctattttaaatagttaaacacatcaccatccagtacttagtttcagtttatttgacctgttttccctctatgaaactttgttgcatatagcatgtctttggagtttttgtgtcttcctaaagataggtgttagcattttcatattactaggcagaatacgtggtggtgcaaatatattacaaaaaacctttttcctttgtctgaaaacagcttctgaaatataaaacagcaactggaaatgttaaaaatgaaggtagtgtgccaccacattattagtgaagctatagatttggcgtttagaatatgaccaatatttaaaattataccttgggtgaatttttcctttttaacaagataaattagcagataagctttaacttgactgaaaattatctttttaaaaataatgtgatatatttcatgaggttgttaattcatttcttgtctgtcacttcttaccagcataaatcttttctgggggtggtagtcagctagtgttgaaagcaacataagagatgtatggggcattttataactttcagatagggcaaattcttaactgtacgccatgaaaaacaactgtctattaaatggaaggtcttgactttgaagaatgttttattaggtaattagagagaaaagtaaaactgtattttgcctatctgaatggtccatccatcacatatctagatatcccattatgtttccagagataccaattatgtttttaatgctaaattatagaactcttaaagagtgacctttaaagtgatcttaaagagggatcagaagggcaaaggaggactaccaaaatgtaattgtaatttccaataatacttatatctaaatgcaaactcttccaaattctgaaagatatgtatttaatcacttaattttggaattagttttagtttcttgattattttatattgacgtagaacttgccatgatgaagctaataaacttgcatgtactggtagatccagtgtagaattctgtttttggtagaaatcattaacacagtgaactcagcatttctttgttacaggcaaccttaatggagaattgatattcgaagctcttaatctgaagatgctagcctcatgttaatacttagtctaattttgaaatacttacgtttgttgaatatcatctgtttgtttgaatagcttatttaggtatcaattagaaagttttgttaggtcttaccttattaatggtagttacaataaagttttaaaatttaattgccaaatgttttgattgttgttctttttcttcttctgctactacatgattttagacattctagaacttatttaagtatatttggttgttcagaacatgccatctgatctgaatttcttggaggattccaggtaaagggatataatcattctaagaaattttagtcttggtggttgagtcttttttcctcgcaaagttgctccaaattcagccaaagctttatctgaaaccttttcttgatgtctcagttttcatttagcatttaatttcccatttcgacctgtattcataagctaagtataagtcttagtctgttttcctgggaagagaaacattcttcacaaaatgttgaagcaatgtcaggaggttgtataggctactactttgtttgttaaaaaaaattattctgtaatgctctaacgtttaggtagggtgagtgctgtcaatatacttgtgcttttttcctactgtaagtgcggcaactcctgttgtcttttttttttttaacatttcctgtttccttttcttttaaatgcatgtttctacaagataaaactgtgttgtcccagtattcatttttgtgggttatgtttctgttctacaaatgataatagaggtagcactttatttaactacatttaacctttttgttgtcttgttttaaagaattaagtgaagcgtaaatgaacatcagccttctatatatgaaagccacatttgagatgtgagcataatcaagtagtttaagcttgtgactctgtttcctttttactggaaaatgggaacaagtaagatgaaaagccgtatactcatgttaagaagtattcacaaaataccttttaagtccttgaaggaacttcagacattttattcagttttccatacatcttttgacagaaagtagattctgtcctcattctcagggacctgagacagcatctccataatagcactaaactattttaaaagtagaaaaaatgaatgcctggcgtggtggcatgtaaggtggtgtgcactgtggcacacacctgtaatcccagctacttgggcaactgaggcaggaggaaggattgcctgagcccaggagagctctgggcgacatagcgagaacctatctctatttttatttttaaaaaattaaattaaaaagtggaaaaatggtaaactcaagtatttgaaagttattaagggattaaaataatttcaatttggactgagacagaaaatttgattatttttaagcgatattaaagtgggcaactattagaggtagttttgttttttcctctccctataatttaggttagtgacctaaaaccattaggcaggtgtatagtaagacaaatgtaatgttcagaaacagtttctttaagaatccttggtggacttctattagtgaattacttagggagaagagcacagatacatctacttgttggggaaaaatctcagtgtttgtttttagtttcttgttataactaaggaatacctgttttttttttattaaaaaatttatttttaactaagttttttttgagacagggtcttgctttgtcacctaggctggagtgcaggcgatcacggctcactgcaggcttgaccccaccaggctcaagggattttcctgcctcagcctcctgaattgctagggctacaggtgcatgccaccatgcctggctaattaaaaacatttttttgtgcgggtgtatgagtagggatggggttttgctatattgcccaggctggtcataaactcctggcttcaagtgatcctcccccctcagcctcccaaagtgctgggattacaggcatgagccactacgcccagccaaaggaatacctcttttatactagggaaatgtaagtatctattatgcaaacaaattgccttattgtaataacctttcaatggttccatatgcaacttgagcaaatctttgagattctaactaatagttcatgatgacattgtcatctgtgtcctaatgaacatgtttgtagcctggtgactgacaatatagaattatatttcaattatttcttaaagttatgtaatgatgactgtaccattagtctaggtaggagtttgcaacactgatgcaacctcttccccgcaaccattggaaggctttttgcaaaagacatgcattaagattgttaaatagaaatgaaactattgaaaatgtgaggaagcaagtgcattgttataaggagaagttttttttttttttttttgagacagggtctcactctgttgcccaggctggagtgcagtggcacgatcttggctcactgcagccttgacctcctgggctcaagtgaataaggaggaattttaaacaattattttatttctctttctttctcatcctttccttttcctttcctctttttcttttttctctttttctatatgaaggaatatttgaaattgcattttagtagcccgagtacaaagggaaagatgagttactttattctgttaaattcttctttcaaagacatggtgcttcctgctattattattattattttttttgagacagagtctcactctgtcgcccaggctggagtgcagtggtgcgatctcgacccactacaacctccgcttcctgggttcaggtgattctcctgcctcagcttcctgagtagctgggattacaggcattggccaccaagcccggctaatttttgtagttttagtagagacggggtttcaccatattggctaggctagtctcaaactcttgacctcaagtaatctgccctcctcggcctcttaaaagtgctgggattataggtgtgagccacggtgcctggcccctgctattatattctaaagagaattgaccctataagggaaatgagaacccaaagagggaattgttttaatacttcatagtaaatattgaagcaaccttgatatacttatatatctcctctccacaaaagacctagatggcatttttaggttatatcttctgatgctagtctgaagcagatgttatttctgtgttgcctggtggaaggaagattgattttgttttatattccagataaacttatgttaggtttaacgtattttgtgaaattagaagcttaatcgtggttttttttttttttttttttttgagatagggtctcactctgttccccaggctgcccaggctggagtgcagtggtactacgatcaccactcactgcagcctcgacctgcaggctcaagtgatcctcccagctcaacctcccaagtagctgggattataggcatgtgccaccacacttggctactttttttttctattttttttttttttttgtagagatggggtctcacttgttggctaggctggctaggctggtcttgtactcctgtgctcaagtgatcctcccacttcggcctcccaaagtgttgggattacaggcatgagccagcatatccaactttaaccagtgttcttaaccaaccactgttctcttctcaacccattagaaggcctgtctagttctccagggaagtagttgaaagtacttgggatcaaacttaaaccagcttaccatttgtaaggtactctcagaataatttttttagtgagaaatgtttaatagctaaatgacattttctttctttgtttttgtttttgagatgggatcttgctctgtcaccctggagtgcaggctggagtgcagtggtgcgatcatggctcactggtgtgatcttggctcactgcagtctcaacttcctgggctctggcgatcctcccacctcagcctcctgagtagctgggcccacaggcgcgtgctaccatgctctgctaattgtttgtgtttttggtagagacagggtttcaccacgttacgaggctggtcttgaactcctgagctcaggtgatattaccaggctggtctcgaactcctgagctcaagtgattcacccaccttggcctcccaaagtgctgggattacagacgtgagctactatgcctggcctgacattttcaaactaaatatttaatttagtagatgctctccattgcccttattttttatttttattttttctgagacagagtctcgctctgttgcccaggttggagtgcggtgatgcagtcttggctcactgcaacctctgcctcctgggttcatgcgattctcctgcctcagcctgtagagtagctgggattacaggtgcgcaccactgcgtccagctaatttttgtatttttagtggagacgaggtttcatcatgttggccaggctggtctcaaactcttgacctcaactgatccacccaccttagcctcccagagttctgggactacaggtgtgagctacagtgcccggcttccattgcctttttattttttggttttgaacatatttgtgaaacctagaagtgaattgttgaccagcaaaagtttactctgttgacttttaataaccttaccctgctcatcctgatgatagggtattgacataatcagaaggcacagaggtgagctgcaaggttatgtataatctgcaaagtagataatctctctgtggatgattgtaatctggcatcttatttagccttagatgtgatatataagcaggttctgtaagtcttaaaattatttgtttcattgactagaaaaaggattactagatataaaagagtaagaaactcttctatatgaattcattggctctctttaaagccttgtgcaacatggaagaatttttttctaaattgtgaaatgtaatgaaaatacagagaagtcatgaaacctcaatatagagcttaaaataatcactgtaagatgcacccccatgtaacttacacccaggtcaaggcaacatactgtttgttcccgatcaaacctttcccacctctcatgtagtaaacattatcctgacatttatggttttcctcttgatttttctctttttttaaccttgcatcttcaactcaaagaaactttcttgattttctttgcagtgtcattacccaatatgtttaatttttttcttgaacttcatataaatgaaatcattgaatatttatcctactgtttctggctgcttttgttcaacagttatgacttttaagattcatccatattgtatgtttgcagttcattgattttccttttttttttagttcattcattttcatagttgcaagatactccatcgtataccagtatttgtttatttttatgctgtcttgttaaacatttttgttgcgtctagtttttggctattactaacagtgccaatagaaacattattatacaacagttttggtgtatacaagcatgtgtttttgtggagtatatactaggtgtagaatctctgggttataggttacactttagctctgttagatattgccaggctatttcagtgtacactcccaccagcagtgtatgagttgaccttgtttcacattgtcactatgtttgatattgtcagacttaaattttttgtaaatatgtatgtaattttactgtggcttatatttccatgagcatctttttatatgttattggtcatttggagtacttctttttttttgtttgtttgagacagagtcttgctctgtcgcctagtttggagtgcggtggtggcgtgatcttggctcactgcaacctctgcctcccgagttcaagcgattcttgtgcctcagcctcctgagtagctgggattacaggtgtgtgccaccacacctggctaatttttgtgtttttagtagagacagggtttcaccatgttgggcaggctggtcttgaactccggacctccgatgatccgcccgccttggcctcccaaagtgctgggattacagacgtgagccaccacgcctgtactggagttcttatttctttttgtgaaaggtctctgtcatatcttttgccttttttgttattgagttgcttgagtttctttcactgatttgtaggggttctttatatagtctgtatttgagccctttttgggttacactgcatgtgttacaactgtcatttttttttaattttaagttctgggatacatgtgcagaatgtgcaggtttgttacataggcatacatttgccatggtggtttgctgcacctatcaacctgtcatctaagttttaagccccacgtgcattaggtatgtgtcctaatgctctccctccccttgctccccaacccccaacaggcaccagtgtgtgatgttcctgtccctgtgtccatgtgttctcattgttcagctctcacttatgagtgagaacatgtggtgtttggtttttttgttcctgtgttagtttgctgagaatgatggtttccagcttcatccatgtccctgcaaaggacatgaactcatccttttttatggttgcatagtattccatggtatatatgtgccacattttctttatccagtctatcattgatgggcatttgggttggtaccaagtttttactcttgtgaatagtgctgcagtgaacatacgtgtgcatgtgtctttatagtagaatgatttataatcctttgggtatatacccagtaatgggattgctgagtcaaatggtatttctggttctagatccttggggaatcaccacactgtcttccacaatggttgaactaatttactcccccaccaacagtgtaaaagcgtatcatcggcagcaaatactctgttgttttccttgaagtgacaggctcacttggttcagttttgagaaaatgcctgtgaaagacccatgtcttaaaaaccatagtttgcttttctttcaagtaaaaaatggtgtttcataaaaacaagctagttcagcttgcaattcaaacaatcgcacaagtgctttacctgtagacaaatactgtggttgtatttgggtgtgtggcagaaattatttatgcaaccttttaaatttcatcatataggctattgaaaggatgtgttattttttaattttaattttttttttttggagatagagtcttgctctctcgcctaggctgcagtgtagtggtgtgatctcggctcactgcaacctctgcctcctgagtccaagcgattctcctgcctcaggctcccgagtagctgggactacaggcatgcactaccacgcctggctaatttttgtattttttagtagagatggggtttcaccatttggtcagactggtcttgaactcctgacctcaagtgatccgccctcctcggcctcccaaactgctgggattacaggcgtgagccaccatgcgagccaaaaggatgtgttcttaaaaaaagacatgcttgcccaggcacagtggctcattcctgtaattccagcagtttgggaggccgaggtgggcagatcacttgtggtcaggagttcgagactggcctggccaacatggtgaaactccatctctacttaaaatacaaaaattagccaggcatggtcgtgcacacctgtaatcccagctactcaggatgctgaggcaggaggattgtttgagcctgagaggtggaggctgcagtgagccaagatagtgccactgcactccagcctgggagacagagcaagactctgtctcaaaacaaacaaacaaacaaaaaaaaccagcaacaacaaaaaaaccccaaaacaacatgttcttagggttcaggatttaacaaaattaacaatttttaagtaacttttttactgtggtaaaaaaaaacacctaacatgaaatctaccttcttagcaaattttaagtgagcagtacaatattgtcaactataagtacaatgttagcagatcttctcctgatctttttcatcttctatgagctgaactttatatccattatacaccaactccccattttccccttcctgcagcctctgacaaccaccattctactttttgcttctgagtttgactacattagatactttatataagtagaatcatacagtatttgtcctgtggctgtcttcttaccttagcacactgtccttaaggttcatccacattgtagcacatgacaggatttccttcttttttttatggctgaataatgtttactttcatagatatacatgacgttttctttatttgctcttctgttggtggacatttaggttgtttctacctctaggctattgtaaataatgctgcagtgaacatgggagtgcagctatctctgtgcgatcctgacttaaatttttttggataagtactcagaagtaggaatgctggatcatttggtagctctacttttcattttttgaggaatctctatactgtttttcataacaattgcattattttattttatttaatttttttcgagagataggcttttgctttgtcacccatgctggagtgcagtggtgcaatcatagctcaccgtaaccttgaactcctgggctcaagtgattctcctgcctcagcctcctaagtggctgggactatagggatgtgccaccatgacccgctaatttttaaattttttttgtagagatggagtcttgctgggttgcccaggctggtctcgaactcctagcctcaagcaattctcatgcctcggcctccaaaaagactgggattgcaggtgtgagccacatgcctggcctattttttttcttttttttgagacaaggtctcactctgttgcctaggctggagtgcatggcatgatctcagctcactgcagccttgacctcctgggctcaagtgatcctcccacctcagcctcccaagtaactgggactataggcctgcaccaccatgccgggctagttttgtctattttttgtggagatgaggtctctttgttacccaggcttattattttttatttttgtttttgagacagcattttgctttgttgcccaggctggagtgctgtagtgaaatcatagctcatcataacctgaaacccctggactcaagcaatcctcccgcttcagcctcccgagtagctaggactcacaccacaatgcctatttctttctttttttttttttgtagagacagggtcttgctatgttgttcaggctgatctccaactaacctcaaggaatcttcctgcctcggccttgcaaattgctagaattacaggcatgggccaccgtgcctggctggcatcaccattttcttttattttggaaatatgttttattttttaattttttttttttgagacagggtctcactctgttgcccaggctggagtgcagtggcgtgatgtcagcatatgttgattgtagagatggagtcttgctaggttgcccaggctggtctcaactcctagcctcaagcaattcttatccttggcctccgaaaaggctaggattgcagacctgagccaccacgcttggcaagagttcccttttatccacatcttcgatacttattttttgtctttttgataatagccattctgacaggtgtgaggtggtatctcattgtagttttaatttgcatttccctagttattaatgattttgaggtttttttttctgttggtcatttgtatgtcttttgagaaatgtctactcaagtcctttgcccattttaaaattgggttgttttcttgacttcttttttttttttttgggagacgaagtcttgctttgttgaccaggctggaatgcagtggcaccatctctgttcactgcaagctctgcctcccgggttgacgccattctcctgcctcagcctcccgagtagctgggactacaggcgcccgccaccacacccgactaattttttcgaatttttttagtagagacagggtttcaccatgttagccaggatggtctcgatttcctgacctcatgatccgcccacctcggcctcccaaagtgctgagattacaggcgtgagccaccgtgcccggccccttgacttctttatatattttggatattaaccccatatttgatgtttggcttgcaaatattttctctgaatccataggttgtctccatcacactgttaattgtttcctttcctgtgtagaaactttttttttttgagacagagtctcgctctgttgcctaggttggagtgcagtgccgcgatcttggcttactgcaatctctgcctcctggatccaagcgattctcctgcctcagcctcctgagtagctggcattacaggcatgcgccaccatgcccggataatttttgtatttttagtagagaagggtttctccatgttggtcaggcttgtcttgaacttctgacctcagattatctgcctgccttggcctcccagactgctaggattataggtatgagccactgcacccggcctcctgtgtagaaactttttttgtttgatgtaatcccatttgtctatttttgctttaattacttgagcttttggggtcaaatctaaaaaattatagcccagaccagtgttgtgtagctcttcccctattttttcttttaggatttttatagtttcaggtcttacatttaagtctttaattcattttgagttgatttttgtatatggtgtgaagtaagtgtccagtttcattgttctgtatgtggatattaagttttcccaacattctttattgaagagactgtcttttttcccattatgtgttcttggtaccctttgttgaaaattaattggctataaatgcatggattaatatctgcgctctctattctgttccattggttgatgtgtctgtttttatgccagcgccatgctcttttaattaccctagttttgtaatatacagttggctggccttatatttagtgggttggctgcatccacagattcaaccaactgcagatcaaaagctgtggatatggagggctgactgttaagtatttttctatctacagttggttgaatccgcagatgcggaacctgcggacgcagaaggatgactgtatatatgccatatataagggacttttgagcatctgtgaatttggtgtgtgtgggagatggtcctggaaccaatcccccgtggatacagagggccaactgtaccttgaagtcaaatagtgtgatactttagcttttttctttttgttcaggattgccttggctattggttttttttttttttttggttccatataaattttaggatttttctgtttctgtgaaaaatggcattggtgttttgatagagattgcattgagtctttatatctcttcgggtagcatggacatttaaacaatcttaattattctaatcaatcagcatggaatatcttttcatttatttgtcatcttcagtttctttcatcagcatttgatagcttgtggtgtatggatctttcacctccttggttaaatttattactaagtattttatttttgtagctattatatttttatttttatttttctctttttgccattcttgcaatgctacaatatagctattttaaatggaattaaaaatttttttcaggtagttcattgttagtatatagaaacactacctatttttgtgtgttgatttttatatcctgtgattttaccctatttattatttccttttttaaaaaaatttttttgccttgatggatacagtatatttattatttctaactttatggtgtagtcattaggattttctaaatataagatcattttgtcagcagagacaatttcacttcttttcttgtttggataactttcatttcttctttttgcccaattgctctggcaaggacttttagtactctgttggatagaagtggagagagtgggcaggtacctgatcttagaggaaaaactttcaacttttcactattgaatataatgttagctatgggcttgttatttatggcctttttttgtgtgtgttgaggaacattcattctatagttagtatgtattttttttttgatatggagtcttgctctgtcgcccaggctggagtgcagtggtgagatctcggctcactgcagcactgcagcctccacctcctgggtccaagcgattctcctgcctcagcttcccaagtatctgggattacagacgcacgccatcacactcggctacttttttttttttttttttttgagacagagtctcgctctgtcgcccaggctggagtgcagtggcgccattttgactcactgcaagctccgcctcccgggttcacgccattctcctggctcagcctcccgagaagctgggtctacacgcgcctgccaccacacctggctaattttgtttttgtatttttagtagagacggagattcaccgtgttagccaggatgatctcgatctccttaccttgtgattcacccgcctcggcctcccaaaatgctgggattacaggcgtgagccaccgtgcccggcccacactcagctgctttttatatttttagtagagatggggtttcaccatgttggccaggctggtctccaattcgtgacttcaagtgatccacctgccttagcctcccaaagtgctgggattacaggcgtgagccactgcgctcagcctctatagttaattgttgagagttttatcataaggatattgaattttgtcaaatgctttttcggcatctaatgagatgatcaagtgatttttatccttcattttgttagtgtaatgtgtcacatttagtgtatgttgtaccatccttgcatcccagggataaatccattgtgatcatggtgaatgatccttttaatgtgctgttaaattctgtttgctggtgtttgttgaggattttttcatctgtgtttataagaggcattgacctgtgattttcttttcttgtaatgtttttgtctggctctggtatcatggtgtagtagcctcttatattcctttttgtttctgtgtaattggttgtaatgttttctcttttgtttctaatattgtttgaattttctttttctttattgaatgtctagctaaagatttgtcagttttgttgatctttttttaaaaaaaactcttaattttattgatttttttcattttcattttcttttttttttttttttgagacaaggtctcactttgtcacccaggctggagtgcagtggtgctatcttggctcactgcagcctcaacatcctgggctcaagtgatcctcccgcctcagccccccaagtagctgggactacaggcgtgggccaccatgcctagctaagtttttgtattttttttgtagagagagggtttcaccatgttgcccaggctgatcttgaactcctgagctcaagctatctgcccgcctcagcctctcaaagtgctaggattacaagcgtgagccaccgcacctggctgatttttttttcttctttaattctctatttcagttgtttctgccctaatctttattatttccttccttctattaactttggacttagtttattcttctttttctagttccttgaagttttgagttaggtggtttgagattaaaaaagaaaaaggcatttataggcctggctccgtggctcacacctgtattcccagaactttgttgggctgaggtgggcagattgcttgagcccaggagttccaaaccagcctgggtaacatggtgaaaccccatctcttcaaaatatacaaaattagctgggcatggtggcatgcacctgtggtcccacctaatgggatgttgggggggtggtggtgctgaggctgaggtgggaggatcacttgagctcaggtcgaggctgcagtgagccaagattttgccattacagtccagcctgggtgatagaatgagatactgtgtcaaaaaaaaaaaaaaaaaagcctttattgctacaaatttcctcttttgaaccgcttttggtatatctcatgaattttggtatttatgttttcattttcatttgtctgaaggtatttcctaatttcctttttgatttcattctttgattctttggttgttcaagaatgtgtttaatttctacataattgtgaactttccagttttctttctggtattgatatctagttttattccattgtgtttggaaaagatacttggtatgatttctatcttttaaaatttgttatttgtttgtgatctaatgtgatcagaatgttagatcacatgttagagcctggaaaaaggtttgtgtgtgcttgagaagaatgtagtctccttatcttgggtggcatgttatggatatgtccattaaatccatttggtctgtagtattattcaagtcttctgtttccttactgatcttttgtctgggtattctatggaaagtagtgtatgaaattccctactattactgtgttggtgtctatttgtttcttcagctctgtgtcacatatattcatatgctgttgtcctctgatgtggtatgtgtatatatttataattgttatattttcaaagtatattttgtctaatataagcatagccacccctgttctctcttggctaacatttgaatggagtatctttatccatcctttcactttcagcctatctgtgtccttaaatttaaaacacgtttcttgtagacagcatacagctttttaaaaaaatagctcatcttaaaaaagatcaatttagatactttgtcttttgaacatggagttagatgttacatttaaggtaattactgacaggaaaggacttactattgccattttgttaattgtttttctgtgttgtagctcttctgttcctcttttcctctcttgcactcttcctttatattttattacatttttccttgcaatttgtttgtttaagagattgggtcactctctgttagattttcccacagtttggattttggtgattgtatccctatggtatctcttaatatattcctctgttgtctttttctgtaaattggtagttggatctagatggcttgatcagattttgattcacactttttttccccctaaagacaacttcataggtaggtgatgctttcttttcttttttcctttttttttttttcctgtctcccaggctggagtacagtggagcgagcagtcatggttcactgcagccccaatttcctgggctcagatgatttgattttttcaccccagcctcccgagtagctgggagtgcaagcatgagccaccatgccaggctaatttttgtattttttgttgagacagggtttcaccacgtttcccaggctggtcttgacctctgggctcaagctatctgcctgtcttggcctcccaaagtgctgggattacaggcgtaagccaccatgcccagcctacatggtgttttctttcatcagaatctggaggcacataatgtgtcatagtctttttttcttttcttttctttactttttttttttttttgtagagacagagtcttgctctgttgccaggctgcagtgcagtggcgcgatcttggctcactgcaacctctgcctcctgggttcaagcaattctcttgcctcagcctccctagtagctgggactacacgtgcatgccgccacgcctgactaatttcttttgtattttagtaaagacggggtttcattgtgttgcccaagctggtctcgaactcctgagctcaggcaatcctcccgccttggccttccaaagtgctaggattacaggcgtgagccactgcgcccagcccatagtctcttttagtaatatgagcagccattggtagatgcctagattcttttattaattaggggtcttaaatggtgatattctaatttcataattccttctttattactacagaggtatttttaatcttctatgagttaccagtggtacagtttgtatatgaaaggcagaataaatgcttgattaaatttttttttacttgccagttgatataatttgctttataagaatcatctcatgttagggtggaaattgaaatacatgttttctattttattctagtttgcatttatgtcggatcctcagtgaaaataaaagccatgatagttcaacatacagaggtaagatttttaaaagtatcttagttatttcttgattaaaattagtaactgtctgctttctattcattgttaggtatgaaaacaaaaggtgtaagatagttcacattatataaaggttttacatggttatattatagtcaggattaaaactgcagttacagtaagactatatctctgtatactgatgttatttgacctgcattataatgatatgatattgcttgacttttgtaattggggcttggtatatttagctaaatttcagcagttgttagctgtatcaatcataaatatgacagaaaagataacatggaaagaaaaattgttctgatcttatttgcactagaaaatttccagaaactgaggttcagtgtttttactaaagctggttatgtttaggtggtgtctagggatcttgttaaaggcagttgtcatgggaaacattcaaaggagttgtttactgcatatcacagatatgatttattaaatgaaatatgtaattaagcagtatgtattataattttccagtaactttagtttcaaaggattttactatttaacattttgttaatttaaaattagacatgtggatttggcaaaggaggggcaaagctaaaagtgattgtgtctagtaagtgtaaagcatttacagtagtattgttgggggtaaaacccacattatttttttaaattagaaaatacatttttataaccgatattctatttgaagccaaaaatcattagataaaatttattatggtcatttaaattatgcttttgtgaaaagaagattaagaacaattttacatatatatatatttatttttgttctaccaaaaatcatgactttcataatagaggatatacttttttttttttttttttttttttaaagtagacagggtctctttccattgcccaggctgtaatgcagtggtggtgtaatcatagctcactgcggcttcaaactcctgggctcaagcaatcctgccacttcagattcccaagtagctgggactgcaagtgtgcaacactgctccttgcttatttatttatttatttatttgagatggagtttcactcttgttgcccaggctggagtgcattggtgcaatctcagctcactgtaacctctgcctcccgggttcaaacgattctcctgcctcagcttcccaagtagctgggattacaggcatgtgacaccatgcctggctaattttgtatttttagtagagacggggtttcaccatgttggtcaggctggtcttgaactcctgacctcaggtgatctgcctgccttggcctcccaaagtgctggtattacaggtgtgagccactgtgcccagccttatttttttaatttattttttgtagagatgaggtgtcttgctatattgcctaggctggtctcatattcttgacctcaagcagtcctttcgcctcaggctcccaaattgttgggattactgtcatgagccaccttgcatagctgaggatatactttttaaagaacatttgggccaggtgcggtggctcacgcctgtaatcctagcactttcggaggctgaggtgggtggatcacttgaggtctggagttcgagaccagcctggctaatatggtgaaactccatctctaccaaaaaaaaaacaaaaacaaaaaaaaattagctgcgtgtggtggcgtgtgcctataatcccagctactcaggaggctgaggtacgagaatcgcttgaacccgggaggcagaggctgtagtgagccaagatcacaccactgcactccagcctgggtgacagagtgaaccttgtttcataaaaagaacatttgggtgtgtgagtggaagatggttttttttttttgagatggaatctcgctctgtcacccaggctggagtgcaatggcgcgatcttggctcacagcaacctctgtctcccaggttcaagcgattctcctgcctcagcctcccgagtagctaggattacaggcgcccgccaccacgcccggcgaacttttgtatttttagtagagacggggtttcaccatgttggccaggctgatatcgaactcctgacctcaggcgattcgcacaccttagcctcccaaagagctgggattacaggcgtgagccaccgtgcccgaccgaaaatgtttttttaacaaatgaaaaagccatttttcaccctgtcatatgggtaagacctgttttaagagttaacattcctagcctgccaccccccaaattattttcttgtttatcctgcttataaaattgcatgatcactcaaaagatttttgaggttgatagacagtaatgtattcttgtttaagttagttgactgtcagaagtataagaatgtacaaaaagactcctttctaaaaatacttgggtactttatcttttttcttccccgggtttaaaatcagtttttaacatctcagttaactttgatcttgtttgatagaaacattaggtggataaaatagaagaattttcaataaatgatagtgtaaatagtgtaaccatgtgactctggatctttaataactattagattattgtttatttgcatggttctgattcacatgtgaaaccagaaatagttatgagtgtggccttattggctgaattgccattgctctccttctcttacccttgcctgcttccttaacacatatactccttggctgatctctgtcaacaggcaggcgttggtttgaggggctccagtttgttgtcctagcaggaaactgactgaatgtcatttcttcagaatctcttttctgtcttaggggtttgagttcgggcagtgtcccctctgacctttctctttctgcccttcccttgaattaatttcatttcaggcaggcagtttcccttgcacacactgcttttccttgtttcttttataaatcaccttcccccccaccccagccactgccaatgaaacaacattgtaatgatggctaataaacatgagtaattggggtacagtgtgatattttgatacgtgtatataatgtgtaatgatcaaattagtgtagttagtgtatcacctcaaacatttatcatttctttgtgttgggaaaattaaaaattccttctagctatttgaaaataaacagtacattattgtttaaaaaaacaaacatgagtagtactagcaatattagacataaccaagaactggtgtcttcaacattcaaaccccgcaaaaactaagaatctctagaagtaccttctcggggccttttttttgagacagagtctcccgctctatcgcccaggctggagtgcagtggcgccatcttggctcactgcaagctccgcctcctgggttcatgccattctcctgcctcaacctcctgagtagccgggactacaggcgcccgccaccacgcccggctaattttttgtatttttagtagagacggggtttcaccatgttagccaggatggtctcggtctccttaccttgtgatccgcccgcctcagcctcccaaagtgctgggattacaggcttgagccaccgcgcccggcctctagtggctattcttaaaactactctttctgaagtgttaacattaagataaaatattttattgaatttttttgtagataactataaggttgtaagttttcctcctcattgtaaatataaagtttttcacctgcaatatagattttataggtttctgtggaactagcctgacagttttaaaccaccacttacagttctatggataaaacacaataggagttcctaaccatttttaaataggcatttagaaaactcgtgaattaggctgggcctggtggctcacgcctataatcccagcactttgggaggccaaagcgggtggatcacttgaggtcaggagttcaagaccagccgggtcaacatggtgaaaccctgtctctaccaaaaatataaaaattagctgggcgtggtggcggacacctgtaattgcagtcacctgggagactgaggctggagaagcgcttgaacccaggaggcagaggttgcagtgagccaagattgcgccactgtaccccagcctggagggcgagactctgtttcaaaagaaaaaaaaaataagaaaacttgtgatttagggactattcgttgctgctgtgtggattacaatgtgattgttcttatgtcactttagtttcagcaaaatgacccaggtcacttgttctctattttaatctccttctgtggttaagattagacttccctggtcccctatgagtaccagaggacatattctcatgggaccttagtttttgataattggctattttgttcttctaagttactgctttaaaaaaaaaaagccaaaaaaaccaccttaattgtctggaaaattttaaataagtattatttgttgtttgttgtaaagcattttattcatggaaatacaaagcataaagttgacctcttatacctgcgataccaaaatacagaaattttttcctttgtttttatattgttatttaaaagcacaacgtagatatagttgtaaaataggcagaatatatttaataaagaattcttcataaataattggaataattattagcaatagcaaatagcaatagcaaatgatttaatgaacaagttaattttactgcaaaatagtattttcattaaggggggatttatgtacattttgatttctattatgttcctttttgtggctaggagtcatagcaggggagaagtttatttttatttttatttttattttttgagacaatggtgctatcacaactcattgcaactttgatctcctgggcttaagttcccgcctcagcctcctgagtacctggcataacaggtgtgtgccaccacatctggctaatttttttttttttttttagtagagatgaggtctccctatgttgcccaggctggtttcgaactcctaggctcaagccgtcctcctgtcttggccccacaaagtgttgggattttaggtgtgagccactgcgcctggctaagaagatttttaaaatatttgattttttaacttgctgtttggttctgaaaaaattttgattccactcaaaaggagattataaatagactttattttacattagcatctttaaagcttcttgtttcactacttttcatgattggaaggaggtaaagttttcagtatatgggacttaaaaaaaagatgaccagaaggaggtgttcacctgaccactaactacccactccaaaaccaaaatatcttttttcaggaaaggggactgtggtaattaatagtgaatgttgctacttgtagttgacagttatcatagaactgccattttatacatgtattttttgtttgatttttatgggacaaagagatttagatttggggagaaatttctctcacactagggtatggttaaaactcggtagtatatgtactgctattctttatctgttgtcactatagtgctgagattgaattgagtatatatctgaagtctactggtgaggagaatgattggtttgaatccacttgctagagttcattgaatataattatagagacttgagtagcatgaaaaaatgctttaaaattgttttggggggaatcagaatgctatatgatgtgcatggtgaatttaaatatgtaaaatctgtagacatacagaaaaaactggaaaggaatgttcaagctgtagttatagtagtggagagatggttaacatttttctaaccttttaattttgtgtttttgtgaaaataaaagaaaaaattgctagaggaaaagcattagaattatatttttcattattgatgtttataataattctgagacgtaggaaatatatagatttacttttcatgttcaagagactgtatccttacattatttctcttatgttcaacagatttccagcaagctctctatgagttgtcatatcatgtaattaaaggaaatctaaagcatgaacaggcatctaatgttcttagtgacattagtgtaagtatgtatatatttttttaagttaatagttgttatatatctttttgctttgacacaaagatccctgaagtttataacttgtattttattcaaaattatagaagtggatggatttttaaaattttatttttttaacttttttcccctcagaactatggaagtgagtaatggatgttttaaggtgacattggtaacccatttttgccagacaggaacacagatagtttaatatttttatctggttgttggtaaagtaggaaatatcaggtaagctggtagggagaaaaaaaaaagcctgtgctgtaatgaaattaaggtatccatgggtgggggaggggggagggataacattaggagatatacctaatgtaaatgatgagttaatgggtgcagcacaccaacacagcacctgtatacatatgtaacaaacctgcacgttgtgcacatgtaccctagaacttaaagtataattaaaaaaaaagaagaaattaaggtgtccttaataaaaaatgccactctaaaaaagtaaattggctaaaatatttttctctcaatatagtataagccattttttgtttgtagttatgtttagaaattaaatatattttaaaaattgaggattaaattattttaaattgcaattgtttggctctaacattcacttggtgctagttttcatttacttatggtttaaaaaatatcgactagattaaaaaaaactcttttacatggttattctgtttcactccttcatttattggagaatttaagttagattcagaccaactatttttcatggtggtttgccatttaaattggaaaatgggctttcaaattgtaaaccagtagttaagcttgaggttttacaagtggcgtgctgttcttttattattaagctggcttttaaacttgtatataaataaaattatcttgtgtctgtgtatatatgtgtatatatacatttataatgaacttgtatatacataaaattcagaatagcttttataataggttttattaaggtgtgggatttgaagcttcttggtctcaatctgaacttctcttactgtgtttctttaatcttctgtagcctttttttctgtcaggggaggtaatatttgtatgttttttgtgctttcccagggatagtcttaaggaaattctaagtttagctgttgtgattttccaccccatattggggtgtatttgagcagtaggaattctgtgagtttcccttttgtctctaaattatctccagctgataacaacagaattagttcatgttggagtagtcaaattcctttttttttaacgttaaaaaaattcagttgctaccaatctttcttaaacaactaatatttcatttttgaaaactcttgtcttactctatttttgatcttcaagtggcctgagtacttgcatttaaatagacataaccagagttcagagcccttaagaaatttgaggctaaaatctgattgacaaggttatttcattttgtaaattgagcattggtataggttttagtttgtttatgggatctgattctgattcttttttcatttattgaaaatggatagttcaagtgaattttatatatgtgtgtttggttcttacatagcttcttctttcttttgaatacttaatgatgtctttatagatacttctgcagcttgattgtctttgtcatggctttctcttagtactatatactgtccagtatcttacccacagaagagtaacttgtgcgtctccttgcagctgccagatttttctttagaatttcttttagtttctgaaaataggctaattttagggttgctatactgccagccaactgttaactgcagtaagtgaactatgatcccttctaatggaaaatagccctaaaattgagcgtgggagtggaaagtcaagagacaagtctagaataatgctgaagtttttattcagaaacaggaggatccttttcttttcttttcttttcttttttctccaagacagtgtcttgctctgttacccaggctagagtgcagtggcacaatcttggctcactacaacctctgtctcccagattcaaacaattctcctgcctcagcctcccgagtagctgggattacaggcgcatgccaccacacccggctaatttttatattcttagtagagacagggtttcatcatgttggccaggctggtcttgaactcttgaccttgtgatccacctgcctcggcctcccaaagtgctaggattacaggcgtgagccactgtgcctggcccgattttgggtcattttctccaaaggctacaagagtaaataaagaaaataaagagaatattgagctccaaaaaagcggggagggaggagggcaataagggttgaaaaactacctattgagtactgtgttcactatttggatgatggattcgatagaaacccaaaccccagcattaccaaatatattcatgtaacaaacctgtacatgtacctcctgaaactgaaaactgcccaaaccagcttttagctttttagctggttttgtattttcaagatttctgtttttctgataccattatgatttttgcataaatcaaatattgactcaggcatgagcacaacatttaaagtcttggatgaaaaatgtacagtttttaacagtcttcctttaggtaagtatgaggcactctaaattcacgtgatttctaaaacgaaacttctttggaaaaatgttactcatttgtgctctttatttcctaaagtgcttgtttaggtttctgtttttttatcaagttattttatggtagacatttaaacattttttgcaaacattatcttcttcctctttgttatgaaagtttacttgaagaattttaatatttgtcaatataatgatggggtttttgttttttaaaaatcttttttcagcaccacctggaaatcaatttttttttttttttttttttttaaagacagagtttcctctgttgcccagggtggagtgcagtggtgcgatcttggctcactgcagcttccacctcccgggctcaaatgatcctcccacctcagcctcctgagtagctagtacaccatcacgcctggctaatttttttttttttttttttttttttttggtagagatggggtttcaccacatggtccaggctggtcccaaacttttgggctcaagtcatctgccctcctcggcctcccaaagtgctgggattacaggtgtgagccactgctcccagccattttttgtttttaagtttcacagaagagtgttattatgaaaccctaatacttgctgtgtgcttttttgctatttattgtaattatatttttaaaattaggaatttcgtgaggatatgccctccattcttgctgatgtattctgcatattaggtaggtattaagcctttatttcacctgtaatgtgctgtgtggtaaatcaaatgtttgttaaataaaatgttttaaactaagaattttacaaatgtttctgcaagtctagaagcaaattgattctttgtagagaatatagcaatataagtcaaatgtcataatcaatgttataaacaaactttagaggtataattcaaattgtttgagtttttgacaatgtagatttctataaatttgagctaaattaagtcatttcaagttaaaaggccaagttttctgagattttggtaaccaaataatcttattcaatgcaggttttcaatgaatgatgtcagaatctcagacttaggactctcaagaaatacttactttgctcttgtactcttttgattcttaattttagaaagagcaagaagagccaaagtaatcaaaagtacttttgttttgaggatgagaaaccagctttgggaatagcaacttctttatttttccagaataaataagggttcatgcaagataaaaaaaggagtatttctgtgacttagaatgaaatgtagtatccgatggcatggatttaaacaataatgtttattataatttttttctctaattttagatctagatgaaaataactgagcacagttttcccttcagtcagtcctgtgctttcttttcttttcttctcttttttgagacatggtcttactctttcgaccaggctggactgcagtggtgtgatcttggctcactgcagcctcaacctcgtgggctcaagtgatcctcctatctcaccgccatgccctgctaaaatatatatatacatataaaatatatgtatatacacatatatattatatatacagatatatataatatatatgtgtataatatatatgtatatatgttatatatgtatgtatgtaatatatattatatatatgtatatatgtattttatatatatctgtatatatatattggtagagatggggtttcaccatgttgtccaggcttgtctggaactcctgggctcaaacgatctgcccacctgagacttctaaagtgctgggattataggcatgagccactgcactaggcccagtcttgtgctttctgtaactttgaatctaatagaagacattgccaaacattattatattcattttatttatttagttagtttttagaggcagagtctcgctatgttgcccaggctggtcttgaatgcctggcttcaagtgatgctcccaccttggccttccaaaatgctgggattataggtgtgagccaccgcacccggccaatattcactttaaaataagacatcctctgcaggtttgtgaacctggaatgaattgttttagctcattaatcttaattcttagaattagataaattacttaaatatcttactgagaatttagaatttgttcttgacaaatataaatcctggtgcttgatccttcaggaagtttcagatttcctaagttcccggtaatgttgggagtaggtcaaaatgtatgtggactgggagtgataaatgaaaagagaagaccattgatgagatgaccacatgtcccagttttgttttgttttcactggctaattattaatagtaccctcttttattctcataactatcctggtttggatgatagagtatatgttcatggtatctgttggattgatgtaagccaaccaaaaaatgttttaagctaaaatttttagtgaggcactaaagatattacctttttttttttttgcaaataaatacatcatgaaacaaatttcagttaaaaatatttttactataaatttgtaagactgtaagactgatgtgtaggtaacattttgtggaagctattgttccttgatagtgtcaggagtatatctttctttgggtaatcatcaattatcagcttattggccctagtaatttctttattgacttactagattatatttttcccttcatagttatttagtaatatgaattattgttacaagtcattgtcttgtacgagtaacatgaattcatgaagatgatgcttggttgcttttgggaaatttctcttagcctatccagtccattttttgtttgagatggcatcttgctctgttgcccagactgagtgcagtggcacgatcttggctcactgcaacctctgcttcctgggttctagtgattctcctgtctcagcctcctgagtagctgggattacaggcgcgtgccaccacgcctggctaattttttttgtatttttagtagagatggggtttcaccatgttggccaggtaggtctcaaactcctgacctcaagtgatctgtccaccttggcctcccacagtgctgggattataggcgtgagctaccgtgcccggcctatccagtccatttttataagcaagattatgacggcaaacttggaaagaggatttccctcacctgctccctcactcacctaccctcacccttggcagaaaaaaaatgattcaagtgtgatcccagatcaaggatggggaataggagtaagaatgctagctacctctaataataatgatgatgatgatgacaataataatgataacaatttaagttctgcttttagagtaccttccatgttctaggcattgtgttaagcatttaatctttgttttaatccttacatcaactcctgtaaaggtggtaggagtacagatcagaaaaatgaggttcagcgaagctgtgatttttcaaggccatgcaagccagtaaggcagaatttgaacctgggtccctttggctccacagcctatgatctttttattacatcatattgtcattctaaatgttgacagttacaagggaaattagtgctgcactttccgggttaagatagcaacttcctccccacccccccacccccccccaccccctcaccacctcccccccgccgcccccagccccgccccgagaatggagtttcagtcttgttgcccaggctggagtgcagtggtgcaatctcggcttgctgcaacctccacctcgtgggttcaagtgattctcctgcctcagcctcctgagtagctgggattacaggcatgtgccagcacgcctagctaatttttgtatttttaatagagatagggtttcgccctgttggccaggctggtctcaaactcctaacctcaggtgatccgcctgccttggcctcccaaagtgctgggattacaggcttgagctaccacgcccggctgatagcaactttaacagactaatagtatgaaggtgagggggcatgagagctatagaaagggggagtctgctgtaagttgatatgctgatggggcctctgggctggggtaggtaattggtgatgctgggcactagagctggaaatagctgagggctttttattgaaatcataggggaaattaaagagaatttattcgaggtaaaggagtcagggataataaatgagtttattagaatggtgttatgagttagagcaaaaagaataaagaaaccagggaaggtacagttgggataatagagtcctgtactgattgttgagatagctcagctaagaaatttactgagactcttttaagcgtttcctaacattgtcagaacccaagagaatggttagacatttaagtaatttatccaattctaagaattaagattaatgagctaaaataattcattccaggttcacaaaccctcagagagtaagtgtcttaatcaggttaagtggctgagaggagagacttgacttgaagaggatgaatctgccatccagtgcccctgttcttagggaccttgagaggtagatcttagggactttagggccctggagcatagatacatgttgggtaaaagaatgggcccagtttagccccaatcccttaaaatcagtatctttaaagttctagactgaggagggaccagaaaaccagatagcagggcaacaattgggagtccctgaaaaggattggtgagatacacatgggttaaaagtcttaatgagaaattgagattgtattgtaatttacattgcataaattataccctaaaatttccttaatacacatgagctaactgtgtgcttagctacagtggccaggatatgtagaaatggcaactgtccaagaagggaaagtcaagggccaggaaaatgtggatatgtttgatgaaaaatccctttctcttttgattcttagtgttggcagtagaacatgtagatgacaatttttattacttcactaaaaccagtgcttctctttatagcatattctaaattatgagttgactgtaaaattaggttaatagtatataatcagttaaagcagtaatcctgagatcagccttgtttgtaatcctgccaatgctggttgaaatttttggtgcttggcatttggcactaattgttttttttcttccacacttcagatcagaaaattttttgacaaattttctgaataatttactgaaactctcagtttttaaatatttcagtaggaagataaaaattttgaataatttctatttactgactagaattataattcaagataagatgttaattttttttttttttgagacagagtcttactctgtcacccaggctggagtgcagtggcgtgatctcggctcactgcaacttctgcctcccaggttcaagtgattctcctgcctcagcctccctagtagctgtacttacagatgtgtgccactgagcccagctgatttttgtatttttagtagagacggggtttcatcatgttgcccaggatggtcttgaacccctgacctcaggtgatccacccgcttcggcctcccaaagtgctaggattacaggtgtgagccactgtacccggccaaaaatatttaatactgtcttttcataaggttggtggccaggtagcttggttagaacatggtaatttgaccagggtggcgaaagtcatgggtttgatcttcatgagtattaggatctttttttttttttttttttgagacagagtctcgctctgttgcccaggctggagtgcagtggcacgatctcggctcactgcaagctccgcctcccgggttcaagcgattctcctgcctcagtctcctgagtagctgcaattacaggcgtgtgccaccaccccaggctaatttttgcatttttagtagagacagggtttcaccatgttggtcaggctggtcttgaactcctgacctcatgatccgcccgccttggcctcccaaagtgctgggattgcaggcgtgagccactgcgcccagcctgagtattaggctctttagagttagaagaaatctttgttataaccctgttcaactttccacctaaaataatcttttttttttttttttagcatctctgacaagtggtcatttaaactttgtttgaatgtttcattttttgcgaacaatagtttttgaagctttgttgcttccagtgccatagcaggtagctccagtgtagttgatgtactgttttatggatctgtcataggtcacagggtcaatctccagttttaggagaaattaaagcattcatataacatctcatgttaccatagttttgaatttttccaaattcagattgaggcattttaaaattagttagtttcaaataaaataagtatcttactttagtgctggggagtctagacaaatcaatcaaacttttttcttcttcatcattatagacattgagacaaattgtttagaagaaaaaagcaagagagactattttacacagttggtattagcatgtttggtaagtttttaaaaatatttttcccttttaaaaatctgcattaaacagttgtaatagaagttaatcatgttaatgaaggaggatattgacattcagttgacttttctcataaggtgagatttgggttttgaaatggaatgttttgtgaaataagacatgctgtttctgtgaaataagcatgtaaccatatccatatcacttaaactatctatacatttaaaacctttggtgatattcctgacctagtaagttcctaagaaaaaggtaagcatttataaagtaagtagaaatgattgtagacagcttttaaatggatttttttcctcataaactgttaagcaaagagtaaaagaatagaggtagtttaaaaatgataaattctagaacttgccatgattgttgtctggtaaaccatttgtgttcataaatttagaaccagggagaactgccgtggttgagacctggaagaaggtgcttgtctttgctatactagaatttaacttaaagtaggaggctattaagtgctgtattaggtgaaagtccagataagccaaatgcagtcatattgaaaatttcatctgtagttcttgtcatttataggcagtatacaacatgcatataattttatagtgaattttttgaaagccgtttattaaatatttcaatatttggagtcaatatttgttaaattgaacttctaagcctttttataaattgtaggttgttatgtagagaatgttatttttgtattcttatttaggaagctttagtttgaatatatttaacattgtggatgcaatgctaaggaataaatgacctttaatattttttaatacagtatttagtttcagacacagttctaaaggaacgcctggatccagaaacactggaatcattagggcttatcaaacaatcacagcaattcaatcaaaagtcagttaaaatcaagacaaaactcttgtaagtacacgtatcttatgttgcagatcaagtatctgagtatgttttttcgttcatattttgaatcctagtagcttctaaggggactttgaagattgttttttttgtttgtggttagcatgtcttgtgttttttgccttctaaaagtagcctaatattgagtcatcagtgatctttacctgtgcaaaaccattgttacttttgcccatattcaaagttaaaataatactcatgctttcatcattagcaataaaataatttatgactgtggctatactcagggtatattcttagagatggaaatggtgatatgttattgttccctgatattaacaatatccttttcttgtgttactggttttccctatgtaattaatattggggttctcatatgaatcactgttattttctactctaaaaggtacacaaagaggtaaactttcaacaactattcttaggattgttgtaggttggagataagaaaattcagtgagaatacagtactctgtgcaagcttgttaattaaaattaattttatccccttaatgatatttatctgatttcagttataagcagcaaaaattcaatttgttaagagaagagaatgaaggttatgccaagctgattgctgaattggggcaagatttatctggaagtattactagtgatttaatcttagaaaatatcaaatctttaataggtaagacatttatctgtatagtatgtgttgttaagataacaagttattttagctattggagaatatccataaagacaaaatgagtgcattccatctattttttttttcagttaaggaatgggagaggtgtttagcttttacttttaatggtttatcaataattataaaatttagcatgatatttgtgagaaatcttattgtcactataccttgtatgttaatattaggtcctgctctgtctagtctttcttttttgtggaggggatcctgagtggtaagccaacactttcaaaagagaatggatgacaaagaacaggatggactgttctgatagagtgccctacgtttctctagtatttctatttttaagtatttctcaaccattttatggaggaccaaaaagcaaacatgaaaactttaatacagtaaatcttcagtgaacttttgaaactacagatgtgtaattttgaacttgattttcaaaataactttacaagggactttgatacttattttatctttatagtagccttttaaagtaagtgcaacagctgttgtaaaagtgtaacagataggaaagttattattctccctaccctttaagtagaattcctgtagcattactgttttctttttatttgcattgagcatttggaagaagtagttgacttctgtaaaaaagatgaatgagcactagaaaaatagggtaatccagattttcctgaggtggaaagagtttttttattatttactaggtgttgtgctatcttagggaagattttgcagtacctgggtcttgagacctgccagaggagtcatattttgtgcctcactagttgtatcttaggggtgcttatcctcagcttcttggttctttctctttttttggagtttatatatgactaagaaagagggagaaggtgtcccaatccttatctccttcctctagtgctttgtgtaggaatccaattaaaactatatttactataatcacctttgttcttaccaacaagtaagtagcttttagtttattttttaaatttttgtttatttattttttaagagacggggtctcgctatgcccaggctggtcttgaactcatgggctcaagcgatctttctgccttggcctcccaaagtactgggattacaggcatgagccactgtgcccaactaaatagccttttgtttaaatttactcttttctttgaagttaatctagttctggcagctgatctagtgtctttgttgtttcttccagttgtcaatttaacaccaagatgggtggccccctagggctgtgggactcttgcttaactgtgtggcagtgacccatttttaaaaaccttcccatggtggttccttagttcctttctgttctttctttctcttttttttttctttttttttttttagatggagtctcactccgtcacccaggctggagtgcagtggcgcaatcccagctcactgcaacctctgcctcccgggttcaagcagttctcctgcctcagcctcctgagtagctgggactccagccaacacacccagctaatttttgtatttttagtagagatggagttttgccatgttggccaggttggtctcaaactcatgacctcaggtgatccgcccgccttggcctcccaaagtgctgggattgcaggcttgagccactgtgcccagcccctttctgttctttctagggtaggcgccacactttcctgagtgttttttgatctagcttgagaaggttttcagtactgctttgctataagtttgtctttccttgtatcctgtcatacttacttaaggtagtattccccacataaaaattctgtgctattttttttttttaactttatatccttttttgttgacatctgtttcttctatttcttgtgagtttatacctttttattcctttgttattttgggaacatttcaaagagggatttttcttgaaggtgtgcttttatcttactagaaaatgtatactacttacttttcttgaactttactctcagggagaacaggctatgatcctgtttctgaagaacagtgtaacaggcacaactgcaagctcatgaggtatatggacagtctatgagtataaacaatttgatttattgggctaaacctatattttaacccaccaagtagcagtcaaatgtcaccttcttagtgaagccttccctgcccacccctgtcaaaactccctgctattccctgattatttttctttttttgcacatatcaccatataatatgctctgtacctcctccccctccacctgtgatgtaggctctgtgaggactggggttttgtttggtaccttatccttaatacttggtatgtaggtgataaataaatactgggtaaaaaaggaatgaatatttcctctattcttgtataatctatactgactcttagcatttttttcctgatatggagaattttagaaagttcatcttcctgtctcagtgtttatttatctctgactaggtgatttcctcctcccccaattgtctgagaaatgaacttttatttttttgagacagagtcttgctttgttgcccaggctagagtgcagtggtacaatcttggctatccgcaacctctgcctcccaggttcaaacgattctcgtgcctcagcctcccgagtagctgggattacaggcgtgcaccaccatgcccagctatttttttgtgtgtgtgtttttagtagagttggggtttcaccaagttggctgggctggtctcgaactcctggcctcaagtgatccacctgcctcagcctcccaaagtgttgggattacaggcgtgagcccccggacacggcctgaatgaaacttttcattgatgtgaaaatagaggttgaaacttcaattccaatgagtattctttcagtgttgttagcatttattggagtccctcttagtgcagacttcatccaggccttgtctcattctgtccagaacacctcactgaccagcatcctatttttcatggcctctttggatgggtttctctgtgtttattcccattgttttctgtttaggaacagtctagacaggtaatacctccttcatcagccagtgtcagaaactgatacctagtttgggcagtatacattttaggtgcacatactttcagggtacttggtctgaccaggataaatccttacttatcatcctttagttaaaaggcagttatttggctggatgcggtggctgaagcttgtaatcccagcactctgggtggccgaggtgggcagatcacctgaggtctggaatttgagaccagcctggccaacatggtaaaaccctgtctctactaaaaacacaaaaattagttgggcatggtggcacatgcctgtaatcccagctactctgaaggcttgggcaggagaatcacttgaacctaggaggtggaggttgcagtgagctgagatcgtgccactgcactccagcctgggtgacagagtgagacactgtctcaaaaaaaaaaaaaaaaaaaaaaaaaggcagttatttgctcctaaaagattctggcacatcaaaatttttatattctgctggataacttggggctgtttactgcatgcgcaagcaaggaagcagaaccattatgcatctgcatggtgattgtgatctgacactaaatttgaacaacttattaaatacgaatgaatagtgaacagtagactattgagctgccaagtcatagacaccatacaagtggccatagcttgaagatggcaaaaaaacatcttttagaaattagaggaaaggatatcacaggtggactcctttgtttgctgaactaaacggtaagaactctactcttttggatgcccttcaaaaaaaatcagagcatcatgctgtacactttaaatatatataataaaaacaagtggttgctaagtgttctttcctttcctttcttctaaatcagtggtcagcaagtgtttctataaagggtgagatagtaaatatttttcggctttgtggaccatatggtttctgttgtaactacttaattctgccattgtagtgtaaaaacagcgtaaaaacagctatagatagtacataaataaatgtgactgtgtgccaataaaatgttatttacaaaaacagaccgctaaatggatttaacccacaagccatagtttgctgattcttgctctaaatcaaaagttctgcctaacaactaatcacggagctagcttatttgagcgtagctttagagagtgaaaatggttcttcctggttttggattttagtggtccaggacctttttggcctaggctctaacccctttacctttgctcgcagaaccagagctttcttcaccaaacctcaagaccttcatttgttgcctggtgtcaaagggtatagatttggctagggaagggtagagtgagagtctttgcctcttcagtctctcaagtgaccagagtaacattaaaaacaaaataaatccttaagccaaacgatttttatttttggatagattatgggacatttcacccctttgactacatgattttgagtgtatttagtattttatctttggttcaatctgaatatagggtccattcaacttagacacatcttattgtgccacctttttcctatttctttgaaagggaagttggctgccttatttacttaaatttttacattattgaagtttcttggctatatgttagaagttttcccttcatagtatgaaaaagaagacagcaattagtgtttccaactataggggttttttgttgttgttatttattttatttttgttttgagacagggtctggctctgttgcccaagctggattgcagtggtacagtcttggctcactgcaacatctgccttttggactcaagccatcctcccacctcagcctcccaaatagctggtactacaggcacacaccaccatgcccgtctaatttttgtattttttgtagagatggggttttgccatgttgccctggcaggtctcgaactcctgagctcaagctatctacctgccttggcctcctaaattgctgggattacaggcgtgagccaccatgcctggccttgttactgttttttagatcatacttttattttgttattcattggttcttgctttgagatgtgcagtttttttgcaaatagtgtttcttagaaatagtctagcatagatttttattagcttctaaagaaactctttctacattgtagatcatttcattttgttaaaaacatgattttctttgtctcctaaggtccattctctcaggaacttgatgattgaggctataattccgttttcttgcctgaaatttataggctggacatctctcctagttatgtctgcaatattatcttggtcttttattttcctgttaagatctcaatttggcctaatttctacaacagtcattgtcagtttgatcatatttcttgcccctagttggtgtcactgtaacataactggttattttttctatctttggggaaactccagttgctttttcctgcatttcttcaaagatgtatcattcaaaaggtgtgaactcttctcaagggtagcgtaaacattttattaatcgctatagtttttcagctttattcaggcttcattgacatatagtagaatgcttatatttaaagtgtacaatttgacttttaatatatgtatacatctgtgaaaataccacaaacaagataatgcacattcctcccactacccctgaaattttctcttgcctctttgtgtttatcctccctctcttctctcttctgttttcccggagaatcacaagcacctggcacatagtgggtagttatttaatacttatttaaatgaaggagggcatctatggccattgtagatctgcagtttctttatttttccacttattctctttaaatatggtttcttgtttgttcctcaaaaggcataaaggcatatgtgtgtgtgtttgtgtgtgtgtgtgtatgtatgtatatgtaaaaatatatatgtgtgtatatatatataaattgctgtgtgtattaatgtagctggtggtagaggtagggagctaggtttgtgatctctgtaaagatcacatgattatcagtgcttgggctggacaaagctcttctaagatgtttgcatacaagactgcttatgttctactacagctgccattagggaaacattttggatattcaaacttactgattattattagagtctcactgtatatgaactagtttaactgttacttaaaacgctaagattttaaaaatgattttcagctgggcatggtggctcatgcttgcaatcccagcactttgggagggtaaggcaggaggatcacttgagactaggagtttgagaccagcctgggcaacatagtgagtccccatctctacaaaaaagttagccaggcatgttggtttgcatctgtagtcctggccaattgggaggctgagatgggaagatcacttgagcccaggagtgtgaggttgcagtgagctatgaatgcaccactacactccagcgtgggcaacagagcgagaccctgtctctaaaaataataataaatgaaaataattttctaaaccttcaattggctaccttttctatcttatggataaaattaattggacttacggcacctgagatatgtaatagaaaactcatgagccagtttttctttaatgaaagatgcaaaggtgatacctgttataagtaaaagtgcacatacctcttgtttcagattactgccttaaattgcacctagaaggaaagtgggtagttgatagtaaaggtcactgatagaatagccttgatgaagtaatgctgttaaataaaacataatgctagtggttcacatttcagcatactgaaaatgtaaacttaaaagcaatgtgaatgaagcacttaaaagattttaatctaacatgttgctgttctattctttatttatgagttttgtgtatgtagcctaatgggtaattataagccagccagtttgccaaaaattatattcagtgtctcttttgtcttctgtgatagagtgttaattcatttttatttagtgatttaattttttatatttagttaatgtaggagaagttacatgatttgataatttgctagatcttacttccataatctatcatcagtgttacagcagtgtgaaggcatttttcatctttgttgaggcttccttgacatacagtaaaatgcacatatttaagatgtgcaatttgagttttaacatatgtatacatctgtgaaaacaccacaaacaagatagtgcacatttctcccattccccctcaatttgcttcttcttgactcactgcagcctctgcctccctggctcaagtaatccttccgcctcagcctcctgagtagctgggactacaggcatgtgccaccatgcctggctaattttttgtagtgacagggttttgccatgttgctgaggctggtctcaaacatctggactcaagtgatctacctgccttgaccttccaaaatgctgagattacaggtgtgagctgccacgcccggcctgatctgctttttgttactgtagattaatttgctttttctagaatttgtctataaatggaatcgtacagtgtgtactgtttttgtctggcttatttcattcagcataattattttgtgattctttcatactgttacctgtatcagtagttcttccctttttattgctgagtatgtccactgtacttttccttactccacttatcctatacggcaaattgcttatccatttatatgttgatggacatttgaggagtattgtatattacagataaacctgccgtgaacatttgtgtacaaatctttgtattgacatagacatttatttctcttgggtaaatacctaggctgggtcatatggtaggtataagtttaaattttaaagaaacttgccaattttacaaagtggttgtaccattttacattgccatcagcagcatttaaggatcttaattgctattttcgaatcacttttatattcataggccatacttttttgaagtacagggggaggtaaaaatatttagaagttttcttcctagaacttcagggaaacgtctttttggagagtttatgaaaatatggagctttttttgagtaagacatgatcactgctttagtccttcttttccttagtttgagaagcggaagaaaatgtgttcttaagtttggatctcataaaaagagggaaaacttgtatttggaggatttggttttctaagtgattgctaaggtagtatgaaacgtgaaatgacattagttttgtagcatttaatataaataagtgtggcgttaatataagtaactggagatatcatcttaccaaagggttgggacatacaacctatggaaattacataggaattttcttgggaaaatcccctaactcatccataaggtataagtgtttagatgtaacatatgtccctaaatttatcacagttcttttttcctccagtattagaagaaatcagtgtttatttgttagcccaatgaagtggttagcttgcatttagggactatgtttaatgaaatatacatattttaaaatactagaatctcattcagcttgatgaaaggcatgtgggaactgacgtaaaccaggagcctccaactcccttggtattctttgatctgttaggataaatagcataccacttttccctttagaatgctactaaaagccatggatataaatcagtggtatattttatagttctgtagtatatgtaagataaaataaaaatgatttttaaaatgatggtccacttttgtgaacccggacttttaactgtttatcagcattccaaatacttctgcctaaaacattaaaaaaaaaccccttttgttgcttaatttgtaaaatgcattgtttgattttcgtgtttttccaagaattaataatgtggacctgtttcactagcccgagtaatcaagaactgatgaggcaaagtgtggcatagaggaatgtttatttgactggtatcactggtcctggactatactgacccagctctgtcattaacccgttctgtgattctgggaaagtcacattctcatctgtaaaaatgtgtagtggatttatttccctctgggagagaggaagcaaatttgtaaagaaagttgtttttaaaaacatttttatcttgctatatgagttattcctgaaaattaatggcttcactagaaatgatgtataatcatttttaaatttttgtatgtctcatctgttgcaggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggtaaagaaaaacgtgtatgtatgtatatttagagattgatttcttaatcttgtttatataatttaatttgttttatttgtaaatgattggtctcatctcaggtgttctagcagaagagatagataaatggatagctaacaatgcaatgtgataagtactatattggtagtatgaatgatgtgatgtgaaagcctagaggaaagaattattaagttttgccttgggagaggtggagtcagggaagactttatagatgtgtctttttttaaacctggtccttgaaggatgaataggagttcattaaggttttctctgcatgagtaacgaacaatgtgagaatcaagatgtggcagtgtgaatatatagagatagaaggaatggttcatagtctgatgtggctgggttgtaagatgggaaaagaagggacaggaaatgaaattgggaaggtatgtgtacttcagattgtcacaggctttgaatactgtgttaagagttagaatcttatttttatttatttattttttattttgagatgggatctcacccagactagtctcagactcctggtccgaagtgaacctcccacctcagcctcccaagtagctgggactacagtcgtgtgccactgtgcttggatcacgaattttgttttataaacaatggctattggaattttttagggatgtgaataaatattcaaggcacatcttacatcattcccttaagccactaaaatagcggtcaagctaatctgtgtctctgattatttctacttcaatccatctttcatattattgttattgttgctttcttaaagagacctaactgaggcacttcactggtcaaaaacctttacttctaggatgaaattcaaacttctaaatgtggcagaaatagcacttcacaatttggcactgttctttccggccttatctttatagttatttttttcttaaatctaatattctagtcatattaagtgactagccatttcttgaacttagatatagatattgctatgaacctttgttcctgtagttccttataactaagaaaccattcttacccaaccctctcacttctcctttcttcatcttgtgaactcctatttattctttaagagcaaatgctgcttgttctgtaaaggcttagctgactctttacccatgcagaattagtcacttcttaatctgtattctcataaaacttgacacataacttctaacacccatcagattatcttagaataaactgtatctatctcctttgccagactgtaaaccatatagggcaggtgaataaactgtatctatctcctttgccagattgtaaaccatatagggaaggttctatgttttactaattcctatggattaatttattgcctagcctatagtaaatgctcactaattgtaaacgagtgatctatgttttaggaagacaattctcttgatagcatggaggattttaatgtaataaggcctccatttaccttttggtatagctctgctaatttgtttacttgcctgggatagtcagctagtcagaaagcattcattgaatgtttatgattatgctgtttgctaggcactgaggttactctggtgtagaggagtgtctgtttctatactcttggagtgtgaggtcaggataataagataattccttttagtattcttaaatgatatagtacctactgcctttgctcatcttgtattttctatgatctgggatgctccagcagacagaagagaaagcagacgacagtttaaaagcatatagcttttcaataccaaacaagagacatggtagggtttttgggcaggagcataatacctttgttcaaaaatgagcagtggcggctgggtgcagtggctcacgcctgtaatcccagcactttgggaggctgaggcgggcagatcacctgaggtcaggagtttgagaccagcctggccaacatggcgaaaccctgcctctgctaaaaatacaaaaaaaaattagccaggcgtggtggcgggcacctgtaatccccactactcgggaggctgagtcaggagaatctcttgaacctgggaggtggaggttgctgtgagccgagatcatgccactgcactccagcctaggcaataagagtaaaactccgtctcagaaagtccactcttggtattgggaaagagagattcaagcattctgtcagattttaagagccaccatgattgctctgggcttgagtacatgaagccaactgctttagtgacaggttggctgaaatttaacttgtgcatgattaattaaaatttaaattagggctttggagactgtgggtttgagagcatatgacagtgaataatgatgacctgcataacatcaggttagttgaatgtgagttttagaatgaaaatctttttgtatgaaaacattccttataaataatgtaacttttctgagctgaattaaaatatacccgggggggtcaacagtatttgaataatctttttttttttgtagacaacgaccatttttcttatataagaaatacttacccaataaatacttaatttagaaataacttgttcttggaatgactaaccctcatattgctctatgtaataccatccctttgtttctattgttagaactgtcttatgggccaggcgtggtagcttacacctgtaattccagcatttttggagggcgaggcaggtgggtcacctgaggttgggagtttgagagcagcctgaacaacgtggaaaaaccttgtctctactaaaaatacaaaattagccgggtgtggtggcgcatgcctgtaatcccagctactcgggaggctgaggcaggagaattgcttgaacccaggaggtgtggaggtagcggtgagccgagatcatgccattgcactccagcctgggcaacaagagcgaaactctgtctcaaaaaaaaaaaaaaagtcttgtcattgtgagaatctgcagttttaagggccactgagggtaggggaagaaatgtcagatatttttgaaaagttttggccttgaaggtaaagtaaggaaagctatgaaaatcaggaactgcttaggtgatgtaaccttgagagttggctcccaagcatatatggtcaatctgtgtattggtccctggcctaattcccccatacccctttcccatcactacctgaaaatgttcacaatccttttccccaactcatatgttgaccagctgggtcttatttggattaataggcttctttttttttccccttaatgctagtattattctatgatatcaacgacagtgagaggttgagcatcccaaatccacaaagctccgaaatccaaaactttttgagcactgaatgatgttcaaaggagatgattggagcattttggattttgggttttcagatttgggatgctcaaccagtatgcaaatattccaaaatctgaaaaaaaattccaaaatctaaaacacttctggtcccaggcattttagatgagggatactcaacttgtacagtagaggatttggggacagcatgagagacagcacaaaggacaggaagggagtacaagaaagtgtgaaggtaccagaagacaaacttgtctggagttgtcttgttacaggaaaggaagaggaggtgataggtctcatccatattgccctttgatttctggattcaaaacacagtaatagtagtaatggtagtaccatggttcaaccctattatacataccccaaattcattcatttaagaaatatagattgagaatctatatttgtgcaaggtagtgtactaggtactgaggctatatctgtaaacagaaattcttacttttttgatgtttagattctgagtaaattatatgttagaaaacaattaatgagatggggaaaaatacagagcaagataagatcaggagtggtaggttgcaattttaactggaatagtgagaatactcattgaaaagttgagatttaagcaaagacatgaaggatatgaggatgtaaactgtatagatgtctgaggaagagcctctaggccaagggaacagtcaatgcaatggctctaaggtgtgagcatgcctgatgtgttgaagaacagtaaggaggtcagtgtggatgtatcagagtgattgagtagaacagtaggagatgaggtcagagatgtgggggatgagatcacagagccagtgcaaggtttttgattttgatactgagtgaagtcagtggagggttttgagtagggtagtgatgtgatctaacttagctttacattttgtttctctctcattttattgtgaacattttcaaatgtagaaaagagtgaatagtataatgaatacttataaccccattacttacaattaagtttattaacatgttgccatattaaaaatattaatttatgttacaaatatcatgaaagcttcttcctaaatactatagtttacggtttttaaaaggaagggcattttccttttttttctttttttgaatggagtttcactcctgttgcccaggctggagcgcatggcgcaatctcggctcatcgcaacctctgcctcctgggtttaagcgattctcctgcctcagcctcctgagtagctgggattacaggtggctgccaccacgcctgtctaattttgtatttttagtagaggtggggtttctccatgttggtcaggctggtcccgaattcccgacctcaggtgatcctccaggatcaatttcataacataattagattactgtcatataataaacctagactgtattcatattttccaaattgtccccaaaatgcattttacacctggtatgttcacatgatgatctaatcaaagaccacatgttgtatttgattgtcaagattcttcgtctcttttaatttagaatagttccccaccttctccattttttaatggcgttgacttattgatgagaccattcctagaagacctcatcttttggatttatctaattgctttttcatcttatttgttctttatttcctgtatttgttctatacttggagttaggtctaaaggcaaaatatttaatggcaaaaatacttcatagattatgtaacatctaatgttcgactgtctttaaatggttcagtaagtttgtgatagtctgattcctcagttatacaatggcatccccccacccccccaccacctttcccttcaataacaaattatctgcaggttgatactttggcagcctgggaatatccagtttctcatcaactttacattaaatggtttagaatccatggatgacctttgcttgagccacctttccctttaggggttccaaattgatgatttactaattttatcatgccctatatatttattagctgtcattcttctaataaagaagagttgtcccttactaactcaggctgtttgctttccttgaaatacggttcctactggaaaggcaggacaaatgattaatattttcccactaattacgagctatcagagtaaggagtttctttaatagcagcctccaatggtgacgtgagttgggtgtgtacatgtgtgtctgtggtgagagagagagagagagagagaatgcatgtgtgtgtgtggttacttagattttcaatggatcagtctgattgtgtgtggcagcagtggatattgatgagattctgaatgtatttgaaggtaaaccaatagtgtttgctgatggattggatacaggatgtgagaaagtagagttaaggactattctgaagttttttggactgagcagttaaaaagatagtgttgtcaccaacttagggaaaatttcaggtagattgggtttggagtgttgggagggagaattaggaattcactttgcgcatgttaagtttgagatgtctcttagacatccaagtgtagataatcgacatatggatctgaaggggtgggttgcccctccgcacctgtgggtgtttttcgttaggtggaacgagagacttggaaaaggaagagacacagagacaaagtatagagaaagaaaaaaagggggcccaggggaccggcgttcagcatacggaggatccatgccggcctctgagttcccttagtatttattgatcattattgggtgtttctcggagagggggatgtggcgggatcataggataatagtggagagaaggtcagcaggtaaacacgtgaacaaaggtctctgcatcataaacaaggtaaagaattaagtattgtgctttggatatgtatacacataaacatctcaatgccttaaagagcagtattgccacccgcatgtcccacctccagccctaaggcggttttcccctatctcagtagatggaatatatgatcgggttttacaccgagacattccattgcccagggaggagcaggagacagatgccttcctcttgtctcaactgcaacgaggcgttccttcctcttttactaatgctcttcagcacagaccctttacgggtgtcggactgggggacggtcaggtctttcccttcccacgaggccatatctcaggctatcacgtggagagaaaccttggacaatacctggctttcctaggcaggggtccctgcagccttccgcagtgttttgtgtgcagtggtttgtgtccctgggtacttgagattagggagtggtgatgactcttaacaagcatgctgccttcaagcatttgtttaacaaagcacaccttgcacagcccttaatccatttaaccctgagttgacacagcacatgtttcagggagcacagggttgggggtagggttacagattaacagcatctcaaggcagaagaatttttcttagtacagaacaaaatggagcctcctatgtctacttctttctacacagacgcagtaacaatctgatctctctttcttttccccacatggatctgagtaaataattggatatacggacctggtgttcaagagaatagaccaggccagaaatagaagtgtgggcatcaaaagcatgtagatgctatataaatacatgacattggatgaaatcactaagggttgtatacagagaggcaagagaagagaaccaaggactaaggcttggggcactccagtgttaagggtctaggagaagacgaggaaccagcaaataaggtagatgaggaacaacatgtaaagtaggaggaaaagagagaatgtggcattttggaagctaaatagaggaaggaatgattaaccatcaaatgcctctgataggtcatttaaggactgaaaattaaccattggagggaggtcaaaactagcagttttggtggaattgggtgatattaagagataatggaaagagtagaattggagacagtgacaattgacaactttatcaagcagttgctacaaaggggtgcagaccaaatgggatggtagatggcaagggaagtgggttcgagatttttttaagatgggagagagaacgcatttgtattctgatgggtatgactgagtggaaagtggagagctggtgttacaggggagagaggtgagaattatttggagcggtgttcttgaggatagagaaaatggagtttggtgcttaaatgggtggattaacttgatataggaggatagagagtttatcataacaggtataaaggcaatatatgtagatatagttgggtaggtgtgattgggagtttgtagaagtctaattgatctaattttcttactgaagtagaaagcaaggacatcagctgagaggatgagagagggaggtattggaggttaggagagaaggtagggaagtacagttatgtgctgcacaatgatgtttcggtcaacaatggaccacatatatgacggtggttgcataagattataatgaaacaggaacacgtagctgaagaagaggcccaagaaaaggaaactacaggagaagaacccccaagaaaattcacagtaaagggtttagcagaagcttttcagcaagctccttaaaaagttgaaaacgtgggccaggcacggtagctcacgcctgtaataccagcactttgggaagccgaggtgggtggatcacttgaggtcaggagttcgagaccagcctggccaacatggagaaaccctgtctctacccaaaaacggaaaaattagctgggcttggtggtgcagacctgtaatcctggctactagggtggctgaggcaggagaatcacttgaacgcgagaggtggagattgcagtgagccgagatcgtgccactgcactgcagcctgggtgacagagcaagactccatctcaaaaaaaaaaaaaaaagtttgaaaacatggaccccaatgctgaccaaggtttttattaatagagaggaatgtacatggcgcattgtctgcttacaagcgaatctgtgatgaaacaaacaaaccaggcaaaccatcgtggcatggacatatttctgaaaagagtgacacctcctcaagaagagcctcaggtccttcaggaggtattccagaagaagacattgtcatcatagatgaccgcttcatgagtgttattgcccctaaacatcttctagtgggacaagatgtggagatggaagacagtgatactgatgattctgatcctgtgtaggcctaggctcatgtgtgtgtttgtgtcttagtttttaacaaacatgtttaaaaagcttaaaaaatcttttttttttttttttttgcgacggagttttgttctccttgcccatgctggagtgcagtggcacaatcttggcctcactgcagcctctgcctcctgggttcaagccattctcctgcctcagcctcccaagtagctgggattacaggcgcctgccactaagcctggctaattttttgtatttttagtagagatggagtttcaccatattggccaggctggtcttgaactcctgacctcaggtgatccgcctgcctcggcctcccaaagtgctgggattacaggcgtgagccactgtgcctgtccagcaaatcttaaaagtacaaaaaagcttatagaataaggatataaagaaaacatatttttgtacagctgtacaatgtgtgttttaagctaagcattattacaaaaaagtcaaaaagttaaaaaaatattaaaaaacttataaggtaagaaagttacagtaactaagcttaatttattttaatttattgaagaaagaaatattaaaataatttaatgtaacctaagtatatagtgtttataaaatatatagtagtgtacagcaatgtcttagaccttcatattcacttactaacttacccagagcaacttctgatcctgcacactccattcttggtgggtgtcctacacaggtgtaccattttaaatattttataccgtaatttttttgttccttttctgtgtttagataggtttagatacacaaacacttatcattgtgttacagttgcctatagtattcaatatagtaacttgctgtacaggtttgtagcctaggagccatagagtattccatatagcctacatgtgtagtaggttatgtaccatataggcttgtgtaagtatgctctaaagaggcattgaatgtatctccgttgttaagtgatacatgatatagttgagtgaatggctaagacaaatggaacatgattgtccagcagcattaagggcccatttgaggacagatacatgaaattggcattatggaaggattgtcattagtggtaataataagatttaggatatggagtaagtggttaagatagggtatagaagatctttggaagagaaagggttcaggagaaccaagaggctacatggtagaaggctcacctacatgtatatgaaaatctccaaaagttaagaattgtagtcagagagagtgacagaggctaatattgttgcaaaatgaagggcagtagactcaaggatccataaatggcatcaataggacatcactgaaagtggcatagtagggaactccagagctctgtctcgccacaaaaacaacataacgaagtggaaaaaactatcagtcaactttgctgctgtcttattcttccccagtcctttccctggttggtgtaagttttttttactatattctagagctctacaaagttaattgagagtgctgtggcattttaaattgcctgtctactagcccccacacccagatcagtggtggccatggtgatagaagcccacactcctggtgcaggttgctaatgctagagggagcaaagaattgtgtttttgggttttaatctggctacctgctccctgaaggacccacataggggcctacttttgtatcttttgactgggagtattctcagggctggtatggcttttgccaaaagcacttaaaggcacaattattgtctgtaatggcctggagcaagggacaacagctgagacaagcagtagtgagaccgaaaagcctgagaaggaagacattagaaaaagagatacatggggaaaaagagctttttacaaagttgtcatatataccataagaaggtcatgcttatgctcagagctgggcacatgcccagaaaaggccaacagagaccctaagctttctcttctgggtctgagtaggcaggaagtgaagactgaggcagagctgtgaatggtctggccaaactttgaggagtgttctaatgcactctcttttcccatttatccaggcctttaaaaaaactgtcaatatactaattggtcactaagctaacagaacatagattcaagtggccacacgtgatgaagaatacaaactttacaaaaaaagtttataaaagtcactaaacacacacacacaacaataaatccacaataagcagcatcaaccaacctctgggtatttgggggtggagaagaatctaatctccatagttgctacataatattaaatatgtccagtttttttttttgtttttttttgaggcagagtctccctctgtcacccaggctgaagtgcagtggcacaatctcggctcactgcaacctctgtctccaggtttcaagtgattctcctgcctcaacctcctaagtacagctgggactacaggtgcgcaccaccatgcctgactaatttttgtctttatagtaaagacagggtttcaccatgttggccaggctggtttcaaactcctgacctcagttgatctgcctgcctcggcctcccagagtgctgggattacaggtgtgagtcactgtgcccagcctagataaggaattgaaatcaatagtcctaaaatgctttatgagctaaaggaaaccaggagtgtgctgtctcaccaaataaatagagaacatccataaagagataaaaattatgaaaaggaaccaaacaaattctggagttgaaaagtacaataactgaaataagaaattcactgtagaggttcaacagtagaattgagcaggtagaagaagccaagccaaagaaagaacactggttaaagtaactctaggtaaaatataaaagccagtactattacatttgtggtttgtaagtcctctttttttcctatatgacttaaaagacaaatacataataattatgaatctttaaaaagataatttcaacttttattttagactcggggtacatgtgcaggtttgttacctgggtatattgtgtgatgctgaggtttggggtacaattcatcccatcacccaggttataaatctgtcaaatggcacactataaaaatgtaatttgtgactaacaataggtggggaggggcagggatgtataggtgcagaggttttgtacactattgaagtgaagttggtattaattcaaactaggttgttttaagtttaaaatgttaattattatacccaaaggaaccactaagaaaataattaaaaactaaacagaaaaaagaaggggatcaaaatggtgcacacacacaaaatcaaacaaaaaaggcagtgatagaggaaatgaggaacaaaaatatgacagaaaacaggtagcaaaatgatagaagttcatccttatctataattattttgaatgtaaatggattaaacccaccaattaaaaggcaagagtttggcagaatgtataaaaaatcatgatccagttacatactgtgtataaggaactcactttggatttagagatacaaatagcttgaaactgaaagtatggaaacatattctgtgcaagcattatgctggagagacctggggtggctatgctaatatcaaagtagactttaagacaataagttgttacaagagacaatgaaaaacattatataatataaaatggataacccattgagaagatataacagttataaacatacctgtaccaaacaacagagccccagagtatttgaagcaaacattggcagacttgaaggaaacatagttgtgtaattattggacatttccataccctactttcattaatggttagaacaactaaccattacttgacaaaagatgagtaagaaaatagaacacttgaacaacgttatatatatagaacattacacacaacaacagaatctacattcttctcaaagcacatggaacattctttagaatagaccatatattaggccacaaaacaagtctcagttgaaatcatgcaaaatatcatctctgaccacaacagaatgaaactagattgcaacaatagtgagggagtagtgagtgatatgaaattcaaagctgggtggatagagggagaatagtctggaagcaacaataacaagcaaaaagaaaactgccacatcacctccaggcctggtagtgtgaggcgtctgaggaaaacagctaccagttaactgcgttacaatggcagggctgttctcagggtgaaccaggctctgtgtgagcaccacggtgaaaagaacctttaaatgagaaatttggatatagggaattttgctgagaatggatcatgaattccatatgattccgtggaagtatttcaaggatgtggaaaggtatgatgggacagaacagggattgtgcataacagtatgtggatgagagtgtggggcatattgtggtgatgtatttaaacaagaatgaagggagtaatgaatgtggccctggtgcattcaagtcaggtagtggaggacaggttgtcaataagttaaataagcttttgtgagtttgttttgaaaccctggccacaattcatttttatgggaaaatgttttgctactaagtaaccatttataagcatttatttttacatgtttttaaaattattttgagatggagtctctctttgtcgcccaggctggagtgcagtggcgtgatcttggctcactgcaacctccgcctcccgggctgaagtgattctcctgcttcagcctcccaggtagctggtattacaggtgcctgccaccacgcctggctaatttttgtatttttaggagagacggggtttcattgtgttgtccgggctggtctcgaactcctgacctcaggtgatctgaccaccttggccttgcaaagtgttgggattacaggcgtgagccactgtgcctggcctgtaagcaaattagaattaggaaactattgttacattgaagacatctcatctgtttttaaaaaatagagtgaaacaatgccttctataaatgatgcacattagtttggttagctttgtattttatttgcataatatcataattgtgggaggaacctcacatacaaaggtctcattttcagtattgactataaaaagaacatagtgtattgttactgtttgctttttatttacatttggccagttagttattgccagttattctcacttcactgttccattcatctgacctcagcagtgttaaaattagctttgaaaattgatagcattcaaagattcttatgtttctatgtagggtcctcatggctggcctggaattgactttgccattctgtactttaaaacatcgatttattcatctgtaatatttatgtacacctgttttgtggagaacatcagctgacagccagatatacttagcataaaacccaagaaataaaattaaaggaagaaaaatataaagcaaatgctgatggttcttctgcacttgacagtttgtctatctgcgtctccactaagaactaacttgaaaaagcaagttaagaaaacacacatgtgtatcagccaggcatggtggctcatgcctgtaatctcatcactttgggaggctgaggtgggaggatcgctagagcccaggagttggagatcagcctgggcaacatagtgagaccccatctctactaaaaaaaaaaaaaagctgggtgtggtggcatatacctgtagttccagctactcaggaggctgaggtgggaggatcgcttgagcctgagaggtcaggactgcagtgagccatgaccatgccactgcactccagactgggtgacagagtgagaccctgtctcaaaaaaaaccctccaaaaccaaaaaacacacaaaaaaacagaaaagaaaacacacatataaacagaactgcagactaaatcttgtgcattataaaatctcacttatgctattcagctgtgagattttatttaaatgttaacctgcattgtaaattgtgtccgtttttgaaattgctttccttgtgttcttcagaagatgttccaatgtgaaaagggatgttggcataataatccttgtactgaattcagatatttggtaagataaggaagagcagtgaagcattttcttggcctagagtatttgatctaattgttcttagttattggtaggtgaaggatattgctttaattgtcctttctgcactaaatggaaacttttttttttatatttctaggaaccaaatggcgagacaccatcatctttatacagagttgcagcagtacttctacaatttaatcttattgatttagatgatctttatgtacatgtaagtcaagtgggctgctaagaatacttgattgtctgtcccaagggtagggaagaggagtaggtagccacatagcacccccaggattgggttggttcgaggttctcaagtctcactctttgaagccccaatacattgttgatttgtgtttactttataaagtgaataaatttagttatttggcagtctatgaaaattaaatacctttttggtcacctttatggagtttaagttttggtcacctttatggagtttaagtttggatatgaagttcaagttcttaactgtcatcaaggcatagctcatggggagagaggccaagttctaaccaatgtggttttttaagcctttttattatctacaaatgatgggaaatataaagttacctatatactgcttctttctctctaaaatgttaattttaggcattcaggatgaatggggaacttcattagtgtatttttatatttagtatatttaaaaaatatttttcttgtgttattcgtgtgcactaaatgactattatgcttttattgctggacccaggatgtagaagagttcatgattgtggcagatgacctctagtttaacaaaaatttagtcatcagtttcagaatctaggctaatagtatataaattcctcttctattaggttttgtattaggatatctattaatttaaaacaagtatgtccaaaggtgatatcatcttcactgcctttgagatcactttattaacatcattgcctatttttgtatactgtggctacagagttgagtaaaacttggtctttaccttggaagcagtcatactctaggaagggagaaaaaaattttgcattatttaataggtactctattggagatattcacaaagctcagaatagatagtgaccatatctgtcttgggggattttggaagactttcccaaactagtgatgttgaactgggatcttgatagacaagtaggaccatctaggctgaaatggtagaaaactttgtaggtagaattaactgagtataaaggcaggagttgttgttgttgttgttttgagacagagtctcactgttgcccaggctggagtgccgtggcactatctcggctcactgcagcctctgcctcctgggttcaagtgattctcctgcctcagcctcccaagtagctgggattacaggcgcatgccaccatgcccaagtaatttttgtatttttagtggagatggggtttcaccatgttggccaggctggtcttgaactcctgacctcaggtgatttgcctgcctcagcctcccaaagtgctgggattacaagcgtgagccaccatgcccagccaaggcaggagatttgaaagggcttttttatccccttatgggactgtcaggaagctcagagtggttggagcctagggtggtatatagggggaatgaggatggaatagagaaagctaaactgttaacggcttaagtgacatagtaaggaatctggatttttctcttgggagtggagagccatattagtatttaaaggagagatgtgatgtagaaactgagaatatggaaaagtggacagaaaagggaaaatttaaaaacacaggtatgactttagagggaagtatagaccggcatatgtggaaagtacaaattgatgatagatttattactcattatgattgcatttagcagtaaatgtaagcagactgagtggtcctgttaatatgacaaagattgtcaagtggaattaaaaatgagtttattatttatatgagaaacagcttaaacttaaggataatgaaatgttgatagtaaaaggatgagaaaatagatcagcaaacttactgttggacaaaatagactttttggcagaaggagataaagcgggctacttcataataacaagattgtgctcactaggaagataaaacagttctaactttacatgtatctaatgacatattctcaaaatacacagaaataaaagttgagagaactataagaagaaacagtttggccattagagggagttgtaattgtctgggtaaaagataaggacctatggccgggcgcagtggctcacacttctaatcccaacactttgggaggccaaggcgggcagatcatctgaggtcaggagttcgagaccagcctgaccaacatgctgaaatcccatctctactaaaagtacaaaatcaccctggggtggtggcacatgcctgtaatcccagctactcgagaggctgaggcagaattgcttgaagccgggaggcagagattgcggtgggccgagatcgtgccatttcactccagcctgggcaacgagagcaaaactgtctcaaaaaaaaaaaaaaagtaaaaaataaaacaagaggacctgtgccaggtgtataagtacagcaatacaaatgtgtttgattgccaggggagaacatacagaatgagaaaaagtcttgcttacttccttgcaccagtccatagtgacttttctctctccctccctcctttttttttttttgataaatggaatgaaatctataatgtttaatagttcattattattttcatttactgtttacattaaacctagttaatggaatagattatgcatttctaggggtcaggaacactccttttatagcttatcatagtgactagcagaaactactgagtaatttgttgcctaaagttttctttgtgttagggttattttataaatgtcttcattaatcatcttccactcatacaaggtgactgtttgagatacttgagcctttttcataatggagggttgactatgcacatagtactttttcttttgcaataaattagtaactagcttgtgacttaaataagctcctagaaaaagtgagatgtcaagttactaataatttttctacttgaaatttttcatttagatgatttaaatttatccctttgtgttattcagtagttcacctttcccaaattggatccatattgcaatgctttatttaatttggagtttagcctttaatggggaaatttgtaatgtttttaatggaactgctatatattttcttgggtaaactaataaattcaacggaaaacatcactgttgtggtattacattactttagggactctgtcagacagaagatgtgaaactttgagctgcgacttgattttaaaaggggtacagaattcaggtacttcattctgtcaaattataagaaaataactgaaatttacttagaaggcaaatggtcacgaataagttagacttcttatttatagttttatcaattgagaatagtgtttcctttttatatgaacaagtagttggtattagctattttatgaaattttaatgtaccatttttagcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaagtatgtaattcattctagtaaaattaacactatcttctggattttgaattatgaaatttaacttctaaatagtcatttatggaagaataatttcttagttttcattttgctgaaacctcattttctggatcatttgctacagtggttttatttttaatctgaatggctcctttttaagagaagctgtcatattttttttcttgtataaatttcaaaatgttttctaagtaaaatcacaagttgtattgactttaattgtcctctgtgtattagtggccctcaaatcctaaagagattctcagagatgatgaattctggtttcctgtggcacgacataacatgaagtagaacttaattccaagtctataaactgtaatgcctgtgtctgtttttttttttaataaatttattattatttttgagacagggtctcactctttcacccgggctggagtgcagtggcatgattacagctcattgcagccttctacctcctgggctcaagtaattctccagccttagcctcctgagtagctgggactacaggcatgcgccaccacacttggctaatttttgtattttttgtagagatgggatttcgccatgttgcccaggcttgtctcaaacttctgagctcaagtgatctgcctacctcagcctcccatgttcctggactataggtgtgagccgctgcgcctggccctgatgttttttcaatagctaaaaattttgattgtacttgcaggaatatattgtttaatttcccatgaatagcaaatatttttgatgtgttgcttaggtcagttttttaagtgacaaagtattaagatttcttgatgtctgtatcctgagtatcttagttttgactattcatttttagccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaaggtatgtaactttatactttattaatcattgaggtagaaatagcttaggactacaacaaaatgtatatttatcttatctcctcaaaccaagcatatattttagtaccttttatcaaaagataagaactattcacagagtgtatcagtctgatatatattaatcagtgacttgtcttctaacgtctagaccaggggttctagaatgtgtgctgcagtgtagtctgaaaactacaagttagacttctaggttgggtttgttccattgagagttgaaactccattcttctggttttgactttccctcctttcagtgggtgggaggggcaaagaattcctgaggttttttcttagtgtaatttttctccatcctggctgagtggctctgagtgaggacattgcctctctgattcccttacctttcctggcatataggctgctgttctggaaattagtagtttagcctctcttatcatccccagttactatgtcatctagtcctttagctttctgcctacttgcaggatacttaggagcagtattgatagcagctgtggctacagccccatagatcagagcctgcctcaaaagcctcagccttgtgacttttgtgtagctgctggttgctgccgtcagtgtcacttcatgggccgtggaccatgcaggcttcttagagagtgacccctgtgactccacagtggggcacctgctgagcaggtgagaactctgggtatggtgtcctaaagtgaccttcttttattacatggctcactttccctacgaccacattctacataccctaggttgtggaatccagattgagaaatgtcagttgacttgaatcagtgttgttatatccatatttttctgtttcatcttccagtgcatcttaggtccatcccttgttgcccattcccatatccaagttcccgataccggccaagtttaaaaacagattcagatggtgtgtgttaaatgttccttgaaatccacacttctctgattaagcagttaatttggaacattctcctctgagctctgattttttttttctaatgactgttgtttttatgtgtttctaccagttgagaattatctggtgtaataaagttaggcacaattgaaatgtagaaagcaaatatgagcaagaaaaaatttcactgattaagataactttgttaaaatggtagatattgtagtgtgtgtgtatatagttatatttattatatacttatttatttgtttatttatttattttactttttaaaatagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggaggtaagtaagatttttcttacaaacctaaattttgaaatgaaaatattctgagtatacttgtgttatgagtatctttagaaataaaaatatgaacctcatttaataaagggttatgttgagtgaggtttgtggaaaattccagtgtgtcctaaccatatgcagtcaagtgttgcttaatgacaggtgagaaatgcatcattaggtgattcgtcattgtgcaaacatcagagagtgtacttatacaagcctagatggtatgacctactacatacctagactatatggtatggcccgttactcctaggctacaaacctgtacagaatgttcccgtactgaatactgtggggagttgtaatacactgttaaatatttgtgtatctgaacatatctaaacatttaaaaggtaataccttgcactaagatgttaggacagccatgatatcactaggcaataggaattttttagctctaatataatgttatatgaccctggtcatatatgtggtccatcaaccgaaacattgttaaatggtgcataactgtatatattaatataaacccaaatctagcgagattattagtcaagtccctcacatgggaaaatatacttcagacaagtggctgcttttttaattcccttatgattagtggttacttagcattcttttccttctagtcattttcttgagtgtagttttcaatcattgctgctatgtgtaagaagtcttttcagcctcagactgttaaggacccattcttttatttatttattcttttactaagatttttattgaaataaaacatacatacggaaaaatacagctcagtgactttccctaaactaagcacccatatgtccactacccaactcaaatagtttacagtcccaccaacagtgtgaaagtgttcctatttctccacctcctctccagcacctgttgttttctgactttttaatgatcgccattctaactggtgtgagatggtatctcattgtggttttgatttgcgtttctctgatggccagtgttgagcattttttcatgtgtctgttggctgcataaatgtcttcttttgagaagtgtctgttcatatccttcgcccacttgttgatggggttgtttgttttttcttctaaatttgtttgagttctttgtagattctggatattagccctttgtcagatgagtagattgcaaaaattttctaccattctgtaggttgccagttcactctgatggtagtttcttttgctgtgcagaagctctttagttagttagatcccatttgtcaattttggcttttgttgccattgctttttgtgttttagacatgaagtccttgcccatgcctatgtcctgaatggtattgcctaggttttcttctagggtttttatggttttaggactaacatttaagtctttaatccatctttgtggaagacagtgtggcgattcctcaaggatctagaacaagaaataccatttgatccagcaatcccattactgggtatatacccaaagaattataaatcatgctgctataaagacacatgcacatgtttgtttactgcggcactatttacaatagcaaagacttggaaccaacccaaatgtccatcaatgatagactggattaagaaaatgtggcacatatataccatggaatactatgcagtcataaaaaaggatgagttcatgtcctttgcagggacatggatgaagctggaaaccatcactctcagcaaactcacaaggacaaaaaaccaaacaccgcatgttctcactcataggtgggaattgaacaaggagaacacttggacacaggaaggggaacttcacacaccggggcctgttgtggggtgtggggagaggggagggatagcatcaggaaatatacctaatgtaaatgactagttaatgggtgcagcacaccaacatggcacatgtatacatatgtaaccaacctgcacattgtgcacatgtaccctagaacttgaagtataaaaaaaaaaaaacagaatagtacctgcaacctagagtctttctcatgctgcattctagttactatcctaaccataaccatttatgctttttttttttaaaaaaatcagctttgaggtataatttaaatacagtaaacttctacaattttatgagttttgacaaatgcatacagttgtatgttcaccaccacaatcatgatatagaagttccctccttccattgctgttcctggcaacctctgataggctttccatcactatagttttgctttttctacatcttatttaataaatggaatcatatggtatatactcttttcagtctagtttcttccacttaagcttttgagatttatccaagttgcatgtgtcagtagttcctttattgctgagtgatattttattacatagacgtaccagagtgtagccaccagttgatgggcgtttgggttgtttctacctggaggctattataaagctgctttcaatattcctgcacaagccttttgggaggcatgtgtttttgtgtccccaggggtgggattgatgggtcatatgagtaagtatatgtttaatttcataagaaattgccaaactgttccaaagcatctgtaccattttgcattcctaacagctattgtatgagacttctaattgttccacattcccaccaacacttgttgttgtcactcttttaagttttagtcattctagtgggtatgtagtggtatctcactgagcttttaattttgttccagtgactagggatgttgatcatcttttcatgtgcttatttgccatttatagttatctttagtgaaatgtctgttcatgtctcttgcacatttttaagttgcgttatttgtctttttattattgagttgtaagagttctttattctggatgcaaggccttatcagatatgtgatactgtgaaatttttttcttagtctgatttgccttttcattttgttaactatcttttgacagcaaaaaattttaacgtttaattctgatttagtagtattttttttttttttttttttttgagacggagtctcgctctgttgcccaggctggagtccagtggcgcgatctcggctcactgcaagctccgcctccctggttcacaccattctcctgcctcagcctcccgagtagctgggactacaggcgcccaccaccacgcccggctaattttttttgtatttttagtagagatggggtttcaccgtgttagccaggatggtctcgatctcctgacctcgtgatctgcccacctcggtctcccaaagtgctgggattacaggcatgagccaccgcgcctggccagtatttttcttttatggtttgcttttcatgctctaagaaatctttgcccagcccaaggttttaaagctgaaaagaattatacatagtttctttaaagttgtgaatcatgacaactaaaaaaaccatctagacattgttaaaaaggacaaatgcagggtgtcttcagtgtttggtgattatatctaatttgaattttagacaacagcaactgtatagaaatactaacggctattgtgtattaatttcttgacatctgaaatatttgacttggctttttatacttagctggtagattttttttgtttgtttttgaggtaggattgcactctgtcatgaaggctggagtgtaagtggcaccaccatggctcactgcagccttgatctctcaggctgaagggatcttcccgcctcagcagcccaagtagctgggaccacaggtgcatgcgccatgcctggctaattttttaaatatttgtagagacagagtctccctatgttgcctaggtaggttgtttttaatgctcacaaatttacattatgtaaaggtactctaaagaaatctgttaagtagttaattattactatatatattgtttattatataatattcatatgaaatggaagtatatcatttctaaatgttgggaacattctaagtcctctgttctgactattttgaaatatataatacattgttgttaactgtggtcaccctactctgctattgaacattggaattcattccatcgatctaactgcatatttgtacctattaatcaacctctgtttattccccctcacccccagcctctgttatctgtcattctatcctctccctccatgagaccacttttttgtttttttgggtttttttgtttgttttgttttgtttttttttgagatggagtttcgctcttgtcgcccaggctggagtgcaatggcgcgacctcggctcactgcaacctccgcctcctgggttcaagcaattctcctgcttcagcctcccgagtagctgggattacaggtgcccgccaccacgcccaactgatgtttgtatttttagtaaagacagggtttcaccatgtttgctacgctggtctcgaactcctgacctcaggtgatctgcccttctccgcctcccaaaatgctggaattacaggcgtgagccactgtgcccggccatgaggccacttttttagctttcacacgagtgagaacatatgatatttgtctttctgtgcctggcttatttcacttaacataaagaccttcagttccatccacattgctgcaaatgatatgatttcattcttttttatggctgaatagtattccattgtgtatatatatatacaccacattttctttattcattcatcagttgatgggcacttaacaggttgattccatagctttgctgttgtgagtagtgttgtaataaacatgagagtgcaggtattcttttgatatattgattacttttcctttggataaatacccagtaatgggattgcttgtaacaaattatcacaggtaccccacaaatatgtacaaatatttgtaccagtaaaaaatttaaagaaatttagaaaggaagtataataatgtttcactcttgatttttattgtctgaaaaggatgattcatgttagctagtgcctgctcaagaaacaaaagggctgtatttttttccagtgcatcatatcaggtgcatgtgaagtcactttgttccattgctggtgatgttaactttatcatttggttaagatgatctctgccaggtttctccactatacagttactatttttccctttgttattaatatatgtcttgtgggaagatataacactttgagactatataaacagactgtttctcctcatactttcacctacctaatgctgctcttttaacttgaaaatcttaatgttcagatctcttgttctgaaattctttggttataaatatcaaacttgtgagcaggagaccaaaccttcaactcatggaagtcctgtacataaccatatacaatattattaccaagatacacacttggtagagctgtcacacttcccctcttgccttctccattgcattcatcctgtacacccgttctgccctagttgtgccaggttcctgcgttaactccagtctattcttgcagagatgaagggcagaagggaagagaaaaatgttagttttgaccatagagaccagtgtaagaagaaatctgcgttttctcattactaggtttgtgatggaaaagtgaatccttacagttatctgagttagaattttgatctatttttacccataaaagattttgctgtgacaaatcatttgttctgtgtttaaatggcttttgttgtctagcttggaattcaagcaggatttttaagattgcttctaaagggtgaatatgaccttagttccaaataatgtatttacaattacacttctttaacaaatctcatttataagcttagggttgcttttatatacaaattatgtatatttttaaaaagaggcttatatacttgtaccagatatcacttaacagaattatcttccagccctatagttatttgtaatttatttctctgattatgtgtatatatgtttcttaaatttgaggtatgtagtatataggactaactcctagtacagtgattctcaaacttcagcatgccttgtaatcacccagaggacttgtttttgtttttgtttttttttgagacgtagtctcgctctgttgccaggctggagtgcagtggcgcaacctcggctcactgcaacctccgcctcctgggttcaagcaattctcctgcctcagcctcccaagtagctgggactacaggcacgcgccaccgtgcccagctactttttgtacttttagcagagacggggtttcaccatgttggccagaatggtcttgatctcttgaccttgtgatccgcccgcctcggcctcccaaagtgctgggattacaggcgtgagccactgtgcccggccaaggacttgttaaaataaattgttgggccccatccttggagtttttgattcagtaggtcttgagatgagaccttagaatttgcatttctaataagttctcctgtgatgttgatgctcctggcccaaagaccaaactttgaggattcttgttctaggcttaagcagtggaggagtgtagtggttctagaattgtttcatgtaaaaggacacattttgctataataacattttctttaattatagagcactaacatgctcacctgacatactcaaatgtttttgatagcacctatatattttttagactttattttttagagcagttttaggttcacagcaaaatccagaggaaggcacaaagatttgctatatagcccctgttcccatatgtgcacagcctcccttgtaatcaacatctcccaccagagtggtacatttgttacagggatgaatccacattgacacatcacccaaagtccatagtttacatcaggatttgctttgtgttgtacatactagggatctcatcaaatgtatagaatattatcactgccctaaaaaatcctctgtgctctgctcatttatccctctctcctcacaacccctggcaaccactgagcttttcattgtctgcgtggttttgccttttccagaaaggcatatagttggaatcagatagtatgtagccttttcagattgttttctttcacttagtaaaattatacacatttaggtttcctctgtgtcttttcatggcttgatagctcatttctttttagcactgaataatatttcattgtctgcatgtatcacagtttatccattcacctactgaaggacatgttggttgcttccaagttttggcaatcaagaataaagctgctgtaagcacctttgtacaagtttttgtgtggacctaggtttttgatctactctgacagtctttgtattttaattggtgcatttagatgatcagtgttcaaagtaattgatatatttggattaatattaatatctaccatttttcttattcttttttagtttttgcccctgttttttgttcttgtttttgtcttccactcttttcctgccctttctggcccatttttggttaagttttttagtgattaccccacagtttgcaatgtacatttacaattgatccaagtccactttcaaacacactattttgcttcatgggtagtgtgagtaccttacaataacagcataatcctaattctttcctcctgacccttgcatcactgaagtcattcatttgcttatacacacacacacacacacacacacacacacacacacacacacacacgcatatgcgtatgtaatcaaatacattgttgctattattattttgaacaaacttatttttgttatattagttaagcataagaaaaataaacattttaccttcacttaatcttacttcagtgtttctttttttgtttgtttatatatatccaagtttctgacctatattctttctctctaaagaacttacttagtatttcttgcaaggcaggtctactggcaacaaattccctcagtttttgtctgagaaagtctttatttctcctttacatttaaagtataatttcacagggtccagaattctagtttttttttttatcttaacactttaaatctttcactccactctgcttgcatagtttctaaggagaaatgttttaaattcttatccttgcttctccataagcaaggtgttctcccccacacccagcatcttttaggattttttctttttctttgattttctgtagttataacatgatatgcccaagtgtagtttttttgtttgttttatttatttgtttatttatttatttatttatttactttttgcatctgtcttgcttggtgttttctgagtttcccgcatctgtggtttggtgcctgatactagtttggggaaattctgtcatcattgcttcaaatatttcttctcttccttccttccttctgctatttccattatgcatatgttacagttttttagtcctacagttcttggatattctgttctgccttttatcagacttttttctctttgcttttcagttttgcaggcttctatggagatatcctcaagctcagaattttttcctcagccgcgttatctcccaataagccatcaaaggcattcttcattctgttacagtgttttttatctgtaggatttctttttttattttttcttaaaatttccatatctctgcttatattgcccctgcccttttttttgaggtggaattttgcttttgtcatccaggctggagtgcaatggcatgatcttggctcactgcaacctccgccccctgggttcaaggagttctcctgccttagcctctctagtagctgggactataagcatgcgccaccacacccagctaatttttctatttttagtagagatgaggtttcaccttgttggccaggctagttttgaactcctgaccttagatgatctacccacctccgcctcccaaagtgctggaattacaggcgtgagccaccatgcccggctccccgcctttgtttttttgagacagagttttgctctgtcacccaggctggagtgcagtggagtgaccctggctcactgcaacctccgccttctgggttcaagcaattctcatgcctcaggctcctgagtagctgtgattacaggcacgtgccaccatgcctggctaattttttatatttttagtagagacggggtttcgccatgttggctaggctggtctaaaactccttgcctcgagtgatacacctgccttggcctcccacagtgctgagattacaggtgtcaaacaccgtacccagccagtcacggaatcttgtttgtctttttccctcctagaagtaaatagcataagttcctctctctctctctctctctttttttttttttttttttttttagacggagtctcgctcttgttgcccaggctggagtgcagtggcatgatctctgctcactgcagcctctgcctcccgggttcacgggttcaagctattctcctgcctcagcctcctcagtagctgggattacaggtgtccactaccacacccagctaatttttgtacttttagtacagacgaggtttctccatgtttgccaggctggtctggaactcctgacctcaggtgatctgcccaccttggcctcccaaagtgctgggattacaggcatgagccaccacgcccggccattaagttcccttttttttttccccagacagagtcttgctttgtcgccaggctagagtgcagtggtgcaatctcagctcattgcaacctccgccttccaggttcaagcgattcttataaatataaataaaatatattttatttattgtgttaggaatgggggagagagattctgtgtttatgttttactctgccatggtaattaatttgtctagaaagactgtatatgtggctatttcatacgttggcgcttggtaaaagccaaagtgctctaaattgatttacaaataaagcttagtaaaacctgaaattaggcaggcagaatataccccagactgggtattagatgacattaggaaataggtgagatagtgatcttgtgttaatatggcggcatgtccttgttcttaggagacaccctgaattattttgagaaacgtgtcatgcctgcaaatttttttggtctgccgaaaaaagggcaaaatgttaattgttgaatttagcaggtaggtatatatagctgtttagtatactatcctttcagtttttatgtaatttgaaatttttcataataaaaatttggattgcaaggagaatgtgccttagaccagtagttccaaaactgtagtttataaaccaaatgctttagaactttgaggctgatgtttactactttttgtttttttgtcagctattacaggagggggagtctgattctgcttcattccacttatttgttttcaaaattgaaaatctgtcttggttatgtagcttaaagcccaagattcttcatagagtagttttaagaaataaatgcgaaggttttagtctgtacgtggcacatagtgagtactaaataaattgtagtaagaatgagaagaaggaggaagttgaaaatagtgttttaattcacacagtttcaggttccagtcttttcaaaaatcttgtgtttttttcctctctcttctgagacataatcctgagtagtgtttgaaatgttcaaggggcagggatacgaaaaatagatcattagtaataaaaaattatctagttatatctacaacttttccatttattccatgactccccaaaaaccctcctcctaataaacctataaacctatatattttttgtgtgtcctgtactgttatgcagcccgatcagctactgtgtctttatagggcaattttggaacttgttttgggccattcagctaatagcctatataggcataattgtggctagttttattcaaacttttttttttttttttttttttttttgagacggagtctagctctgtcacccaggctggaatgcagtggcgcaatctcacctcaccataacctctgcctcctaggttcacgcgattctcctgcctcagcctcctgagtagctgggattacaggtgcgcgcccaccatgcccagctaatctttgcatttttttttagtagagaaggggtttcaccatgttggtcaggctggtcttgagctcctgacctcgtgatccgtggtctcagcctcccaaagtgttgggattacaggcgtgagccactgcactctgcctattcaaacttaaaaattcagttgctcacaggcaagtgtgtgtgtatatatatatatatttattattattattatactttaagttctgggatacatgtgcagaacgtgcatgtttgttacatagatatacacgtgccatggtggtttgctgcacccatcaacccatcatctacattaggtatttctcctaatgctatccctcccctaaccccctaccctgctacagacccctgtgtgtgatgttcccctccctgtgtccttgtgttctaattgttcaactcccacttacgaatgagaacatgcggtgtttggttttctgttcctgtgttagtttgctgagaatgatggtttccagcttcatccatgtccctgcaaaggacatgaactcatccatttttgtggccgcatagtattccatggtgtatatgtgccacattttctttatccagtctatcatttatgggcatttgggtgggttctaagtctttgctattgtgaacagtgctgcagtaaacatacgtgtgcatgtgtctttatagtagaatgatttataatcctctgggtatatacccagtaatgggattgctgggtcaaatggtatttttagttctagatccttgaggaattgccacactgtcttccacaatggttgaactaatttacaacagtgtaaaagcattaccatttctccacatccttgtcagcatctgttgtttcctgactttttaatgatcaccattctaactggtgtgagatggtatctcattgtggttttgatttgcatttctctaatgaccagtaatgatgagcatttttttcatgtttgttggctgcataaatgtcttcttttgagaagtgtctgttcatatcattcgcccactttttgatgggttttttttttcttgtaaatttgtttaagttccttctagattctggatattagcccttttgtcagatggatagattacaaaaattttctcccattctgtaggttgcttgttcattctgatgatagtttcttttgctgtgcagaatagtttaattagatcccgtttgtcaattctggcttttgttgccattgcttttggtgttttagtcatgaagtctttgcccatgcctttgtcctaaatggtattgcctaaattttcttctagggtttttcgggtttgaggtcttaacgtttaagtcttttaatccatcttgagttaattgttgtatatggtgtaaggaaggggtccagtttcagttttctgcatatggctagccagttttccaacaccatttattaaataggggatcctttccccattgcttgtttttgtcaggtttgtcaaagatcagatagttgtagatgtgtggtgttatttctgaggcttctgttctgttccattggtctatgtatctgttttggtaccagtaccatgctattttggttactgtagccttgtagtatagtttgaagtgaggtagcatgatgcctccagctttgttctttttgcttaggattgtcttgggtacacgagctcttttttggttccttatgaaatttaaagtagttttttctaactctgaaaaaagtcactggtagcttgatggggatagcattgaatctataaattactttggatggtgtggccattttcacgatattgattcttcctacccatgagcatggaatgtttttccatttgtttgtgtcctctcttatttccttgagcagtagtttgtagttctccttgaggaggtccttcacatcccttataagctgtattcctaggtattttattctctctgtagcagttgtgaacgggagttcactcatgatttggctctctattattggtgtataggaatgcttgtgatttttgcacattgattttgtatcctgagactttgctgaggttgcttatcagcttaaggagattgtgggctgagacaatggggttttctaaatatacaatcatgtcatctgcaaacagagacaatttgacttcctctcttcctatttcagtaccctttatttctttctcttggctgattgccctgaccagaacttccaatactatgttgaataggaatggtgagagagggcatccctgtgttgtgctggttttcaaagggaatgcttccagcttttgctcactcagtatgatattggctgtgggtttgtcataaatagttcttattattttgagatatgttccatcgatacctagtttattgagagtttttagcatgaaggggtgttgaattttctcgaaggccttttctgcatctattgagataatcaggtagtttttgtcattggttctgttaatgtgatggattacgtttattgatttgcctatgttgaaccagccttgcatccccgggatgaagccaacttgattgtggtggataaactttttgatgtgctgctggattcggttttgccagtattttattgaggatttttgcatctatgttcatcagggatgttggcctgtgtgtctgccaggttttagtatcaggatgatgctggcctcgtaaaatgagctagggtggtgtccctctttttctattgtttggaatagtttcagaaagaatggtacgagctcctctttgtacttctggtagaatttggctttgaatccgtcttgtcctgggccttttttggttgttaggttattagttactgcctcaatttcagaacttgttattggtctattcagggattccacttcttcctggtttagtcttggggggggggcgtatgtgtccaggaatttatccatttcttctagattttctagtttatttgcgtagaggtgtttatagtattctctgatggtagtttgtatttctgtgggatcaatggtgatatcccctttataattttttattgtgtctatttgagtcttctctctttcttctttattaatctggctagcagtctattttgttaatcttttcagaaaaccagcttctggattccgtgatactttgaagggttttttgtgtctctatctccttcagttctgctctgatcttagttatttcttgtcttctgctagattttgagtttgtttgctcttgcttctctacttcttttaattgtgatgttaggatgtcgattttagatcttttccgctttctcctgtgggcatttagtgctataaatttctctctaaacactgccttagctgcatcccatagattgtggtacattttgtctttgttctcattggtttcaaataacttgtttatttctgtcttaattgcattgtttacccagtagtcattcaggagcaagttgttcagtttccatgtagttgtgtgtttttttcttaatcccgagttctaatttgattgcactgtggtccgagagactgtttgttatgatttccattattttgcatgtcctgaggagtcttttacgtccaattatgtgctcaattttagaataagtgtgatgtgatgctgagaagaatgtatattctgttgatttgaggtggagagttctgtagatgtctattaggtccacttggtccagagctgagttcacgtcctgaatatccttgttaattttctgtgtcgttgatctgtctaatattgacagtggggtgttaaagtctcccactattattgtgtggcagccaaaatctctttgtaggtctctaagaacttgctttatgaatctggatgctcctgtattgggcgcatatatatttagtatagttagctcttcttgttacgttgatccctttaccattaggtaatgcctctctttgtctttttttgatctttgttgttttaacgtctgttttatcagagactaggattgcaacctctgctttttttgctttctatttgcttggtaaatcttcctccatccctttattttgagcctatgtgtgtctttgcacgtgagatgggtctcctgaatacagcacactgataggtcttgaccctatccaatttcctagtctatgtcttttaatttaggggcatttggcccatttatatttaaggttaatattgttatatgtgaatttgatcctgtcattatgatgctagctggttatcttgcttgttagtcgatgcagtttcttcatagtgtcgatggtctttacaatttggtaggtttttgcagtagctggtttcagtctttcctttccatatttagtgcttccttcaggagctcatgtaaggcaggcctggtagtgacataatctctcagcatttgcttgactgtaaaggattttatttctccttctcttataaagcttagtttggctggatatgaaattcggggttgaaaattcttttctttaagaatgtttatttttagcccccaatctcttctggcttgtaaggtttctgctgagagatccgctgttagtctgatgggcttccctttgtgggtaacccgacctttctctctggctgcccttaacatttttttcttcgtttcaaccttggtgaatctgacgattatgtgtcttggggttgctcttctcgaggagtatctttgtggtggtctctgtatttcctgaattttgaatgttggcctgtcttgctagattggagaagttttcctggataataccctgaagagtgttttccaacttggttccattctcttcgtcactttcaggtacaccaatcaaacgtaggtttggtcttttcacatagtcccatatttcttggaagctttgtttgttcctttacattcttttttctctaatcttgtcttcacattttgtttcattaaattgatcttcagtctctgatatcctttcttctgcttggtcgattcggctattgatacttgtgtatgcttcaggaagttctcatgctgtatttttcagctccatcaggtcatttatgttcttctcttaactggttattctagttagcaattctctaaccttttttcaaggttcttagcttccttgcatttggttagaacatgctcctttagcttggaggaatttcttattacccaccttctgaagcctacttctgtcaattcctcaaactcattctttgtccagttttgttcccttgttgttgaggagttgtgatcctttggaggaggggaggcattctggtttttggaattttcagcctttttgtgctgtttttttctcatcttcatggatttatctacctttggtctttgtcgttcagatggggtttttgtgtggacatcctatttgttggtgttgactctattcctttctgtttgttttccttctaatagtcaggcccctctgctgcaggtctgctggagtttgctggaggtccactccagaccctgtttgcctgggtagctccagcagaggctgcagaactgcaaagattgttgtcttttccttcttcgggaagcttcctcctagaggggcacccgccagatgccagccagagctctcctgtatgatgtgtctgtcgacccctgctgggaagtgtctctcagtcaggaggcacagggatcagggacccacttgaggaagcagtctgtcccttagcagagcttgagcactgtgctgagagatccgctgccctcttcagagctggcaggcaggaacgtttaagtctgctgaagctgtgcccacagccgcctcttccccaaggtgctctgtcctagggtgttgggagttttatttataagcccctgactggggctgctgcctttctttcagagatgccctgcccagagaggaggaatttagagaggcagtcaggctacaccagctttgtgacgctgcagtgggctctgctcactttgaacttcccagcagctttgtttacactgtgaggggaaaacccgcctactcaagcctcagtaattgcacacgcccctcctcccgctgagctccagcgtcccaggtcgacttcagactgctgtgctggcagcgagaatgtcaagccggtgcatcttagcttgccgggctccgtgggggtgggatctgctgagctagaccacttggctctgtggcttcagccccctttccaggggagtggatggttctgtctcgcctggtgttccaggcgctactggggtttgaaagaaaactccagcagcagcagctagctcagtgtctgcccaaacggccacccagttttgtgcttgaaacccaggaccctggtagtgtaggcacagaggaagtctcctggtctgtgggttgtgaagactgtgggaaaagcttagtatctgggccagaatgcactgttcctcactgcacagtccttcacggcttcccttggctaggggagagagttccccgaccccttgcacttcccgggtgaggcaatgccccaccctgctttggctcgccctctgtgggctgcacccactgtttaaccagtcccactgagatgagccgggtacctcagttggaaatgcagaaatcattcaccttcttcgttgatcttgttgggagctgcagaccggagctgttcctatttggctttcttgccagccaccgaacccgtgatttctgagagttcatagaagttaggctgattacatttaaacaatttgccaggtctcaacaatccatatagctttttttaacttcccatttgatcttcttagatctgcaagttttattttccattttcaaaatcttttttttttttttttttttttgagacagagtcttgttgtgttgcttaggctggagtgcagtggcgtgatctaggctcactgcaacctcaacctccacctcccaggttcaagcgattctcctgcctcagcctcccgagtagctgggactacaggcgagtgccaccatgcccagctaattttttgcatttttaggagagatggggtttcaccatgttggtcaggctggtctcgaactcccgacctcatgatctgtctgcctcagcttcccaaagtgcttggattacaggcgtcagccaccgtgcctggcccaagtacagtttttgatcttcaagaggtgcctgtactctgtcctgttcatatttgaattcccaatgcctggaatctagtcattgaatgaatgaatgaatgaatgaatgcatgtctcttgttctccctccctgtttctgtctccctcccatttctagctggcattcagtaaaacttatagtattatgtgagagtcttacagttgctttgaattaaaaagcaaattaaactaaaagaaaaagtatcaagggagtagaatatattttcctaccaaacaaaagaaaattgcttttatttgcatgtacttcttgatttaattttgtacattcttgctataattcgactttgataggaaggtcttttactgctcttctagatggttttattttgcttcctatatttctttccccttttcaaattttcctgcttaatgaaatctagagaattgatgtttgaaattgatatgaaacctagagaatagatgcttgaaactcatatgagtcacctagaaagggagttaggacaacttagtaaataagaaaatgttttatttctatgggaaaaaaactgtgtgtcgctttattaggtttgtttaaattatagtataccaggaaaggaggagcttaactgtctttttccccgacataatataccataaacctagtttttccagttacaggatacctgtatttttgcttcccaatgtacaccctatgtgccaccagaattatgtgtgtgctaccttaccaccccgaaaccaaaccaaaccatctggcttttttctgccaggccactcctttataacccagttccttctttgcttaccaggatatatgttgacttaataaattatttctgtgaaaggaaccatacctttttaacctgccaattaaaaacaaattgagtgtatgtattttcccataaaggtaacatggcaggccctgaattagtgttatgtgaaaatgtagcataacagttagacttttcctgtggtaatatccattatattactgaagtgtgaaagcgtatgcatacacaaaacacccttatctaccaagaaaataagaagcttgttatctgcatattagcttttccctctttctcacttgatattgagctaaatccttgccagaaatctagattgtcactggttgtcagtacttcagttgtctttttggcctctacagactccgccagccctctgtctgtttatattcacacaagtatcattcactgtttcattttgaattaatagacatccttgtcaaacatcactttaggggctcatctgtaaatctgcaaattgtttatataatacggacccaggatttttcattcagtctgtacaatttaagcaatggttttgtctttgttagtaatgttactggtattttgggcttatctttcagtgaggactttgggagtggtgaattaaaagatagatttaaatttctttgcgtttaattttggctttgtttttgcatttttgttgctttagtgtttgattatactaattccatagaagaaaaactataatctctggatggaaaaatgcaaatgtattataatgaagtttttgtactggccacaatttttttttttttttgctcttgttgtccaggctggcgtgcaatggcacgatctcggctcactgcaacctacacctcccgggttcaagtggttctcctgcctaagcctcctgagtagctgggactacaggtgtgcgccaccatgcctggctaatttttgtatttttagtagagacggggtttcgccatgttggccaggctggtctcgaactcctgacctcaggtgatctgcccacgttggcctcccaaagtgctgggattacaggcgtgaggcaccgcgcccagcccttgctacacttttataataaattcttagatcaattttaggatgctttggtttgataggttgagaaaagaattggtttataaaaattgacacttaaaattcatggatgtcaagtatgacttagaggttagaaacagataaaatttaaaaaggttaacaggctatatttaaaatctacatatttgtaaaaagtaagaacaatttacaaccatgtgcaagttaaagttttttcaaattagaaattaattgtgacatcataatcttaacctttttgtattttattaatttctttttttaaattgtagtttcagtctgatggaagcaaacaagaagataaagaaaaaacggtaagagactagaaaaatccaataatgtgtctaatgtttgtcttgctacagtatattacaaattttactgtgaacaagctttaatcatctgtatgagtaattgttttataatgtagatgctgattatagtttttggcggcatatgcaaagttatcttttaagattaacattttttcccctgatgttgaaaaaggaagagagataaaagttcctcattcctttgctacccctttcctttcctcaccccattttatgtcttcgatggagaaacataaataagctttgtgaaaagggtgggtgaggaatgggatattgtgtgttatgttattaagaaatggtaattttcccaaggctgttataaatttattgttggttatattaatatagacctcttactgaaataacttttccttctttcttttaggaagttatccttagctgtttgcttagcattactgaccaggtactacttccatctctttctttgatggactgcaatgcttgtatgtctgaggaactatggggaatgtttaaaacatttccatatcagcataggtaaatacatattattttcatgtttttaactattagtaattctagtatattaacctctaagtgtttaacttttcctaattcttcatctcatcgttttttaagatatcgtctgtatggccagtggaagaatgaaacttataacagtcacccacttttagtaaaagttaaagctcaaacaatagacagagccaaatatatcatgaagtaagttttaatttatttttcatattaatctaaattatatctgaatctaatatactttctttcaggtagcttgtctgagcctcagttttgggaaagcctatgtgttgtgaatggtatagctgatttatatactacagatggaatgactgttaactgtggttttagctcattttgactaccaagttaatgttttcatagttgttgtgtttacatatggataaaaatctaatggaaatcctctttaatatgtgcatcatattatgggatgaaggttttgttttttctttttaaggacagcctgctgtggcctttgcttacctttagtgatttgtgcaaggtagtaaaagttctagcaatttccactgctgaaagttaccataatgaatttttttaatctgttaggaagaactaatgaaattatccagaactatctccatagggagtcaacttttgagaaatttcttttttaaaaaaatttgtacacttttattttcatatcattaaaaacataagagtgatgttctacttcccagtagattatttgaagtttaattatgaaaatcatgtacttcagattagtattagtttagatgcttaattgtattgctgtattgcaagtgttttcaacgaggctattgtcagttgtcattccttttttaaattcatggcagtggtatggttattctaattaaaagtagttcgttctcagtttatttagatttaacagtgtgtaatgtctgttaaatgttgtccttgcccagtgatattgtttctggtcacagcctattgggaaaacaggtgtgtgcatgatcacaatctagttgttgtttttttttttttttcctgtgagcctatggattatattgaaacaacctagtataataggtgctgttatacagtatgaataaagtgctatgggaggatagatgagactaaatgatttcacttgggggagttttgtttggcaggagttgatattagatctgaaagagtttctggacttaagagttctccaggtacagtttctagcttaacaacagcagctaatatttagggagctattactgtatgtgccaggcattaaactaagtgctctgcatggattgtttaataatacattaagcatttttaaataccttgaattcatccactgtcactaccactactaccttagttattttatctggtgtattatagttgtatattctcttacctaaaaatcctttggtgactgactttacctgaaggtatatgttaagctttatggcatggtgatataaataagaggtcctccctggtttgtccctccctgcatccaacctcctttcctgccaattctacttccagatgtactgagcctacttatgtcccctaaatgtaccactctctccttagcttctcttcccctgtatatactttttgttccctctgtttgtacaggttttcccttaccttcctttccccctttccatctggtgacctcattcttggagagtgagctccagtgttacttctagtgaaggcttccctagcataaactgccagacacaatcaatctttatttccatcactattctttagcatataatgttatcatacctctaggtaccttgctatgattgttttttgaatagtttatgtgtttacatgatttaagtttcagtaaatataaaaggtataaatacagcaaaaagtctcactccatcctccatctactcagttcttcccctcaaggaaaagtaaccactgtttagtctcttatttatccttccatatattcttatgtatatgcaagccaatacaatatatattatccccctcttatattattattatattaatattgtttttctttgtaaaaatgggacctcactatgttgcccaggctggtcttgaactcctggcctcaagtgatcctcccaccttgacctcccagcgctggagttacagacgtgagctaccacaccccagccaccttttatattatcaatagcatataagtactgttctgttgattgctcttttttagaatattgaaatttaataaatgaatttaaatctgtctccttcactggaccaggcttgagagcaggaactgttactctgttattcatccttgtatttcttatttttttttttttttttgggagatggagttttgcaccgttgcccgggctggagtgctgcagtggcacgatcttggctcactgcaacctccgcctcctgtgttcaagcgattatcctgcctcagcctcccaagtagttgggattacaggcgcctgccaccaagtccagctaattctttgtatttttagtagagacggggtttcaccatgttggccaggctggtctcgaactcctgaccttgtgattcacccgccttggcctcccaaagtggtgggattacaggcgtgagccactgcacgcggcttcatccttatatttctacactgaccttagctaaaaggctgagacacaatcttccttgtatttctaatgcttagtactttgactgtcatcgtaggcattaatatgaatgaatgaataaaaatacaatttactacagaatagtatgtgcagaatttttaatatacttggatttttgttatatttgtaagctataactattttaccaggcttaaacaatatgattttgttactgtttgaagtttttacattgagcatataatgtattaacttattacttgtagaatttcatgagttttgaatactatttaaaacatgagcttgctatagggcatttagtaattctttctacaaatgtttattatgttccatatgctagacactggtagtttgaggggaagacaaagacaagaaaatatttctttaatttttgtttgtttgtccctccagggtgatggaggcagaagggaatggaatgaaaaacagagaaaggaggggttggccttggcaagtagagggaggcacctgaaatattggggttagaaatagggacaggtagtggtaagttggaaatttgaacaaaatactgtatagctaacttttaaaactaatggtctctcttttctatgaaaccaaaactgggatatggagaattggaaagggaagcagttgatgaaacagttttgattgatggggccagttttgtcatgagaaattaattaaagcaagttcgtcacttggagaatggtcacatctcctgaattataaactgaattcataatttacttcattatattttcatcctagaaagcttccttcctgtcacttgtagccttttgaagtctctagatttattatgtaatcatctcaggagaggcatttaagattctgtgtaataattgttttgaactgtaagaattcatagataaaatttgcagaatgctggcaaaaggataatgagcaaaggaagaaataaagaggaaggaaaggagtagaatttagtttcaaaatattgtttaccttgaatatgaaaagcagataactttacatattgagggagtaaagttacataagtttacagataacacagtaactctgttagagtcactgagacagatggcacgagacatttcattgcatgacaccaaatttgatatcttaatccctaaactgatgagtcctcctaaatctgaaataattttgattctttgtaagaagagttttatgtacttgtagagtacattaagagttttactgattattagactattactataaagtggaaatgtgtattttataaatgttaagcatttaatataaaatgttaatatcctctgagagaatccctaaccaaaatagcccaaatcctaccataaaggatgtgatgaatgtagttgtttacatgaatccattttggatatttggggaataattgctttttcccccacgatgatgtaacaaagctatcaacattacaaggaatgttacttaagatgatccgtgccacctttttcttcctccgtaggcgcctaaccaaggaaaatgtgaagccttctggaagacaaattgggaagttgagccacagcaatccaaccattttgtttgattatgtatgttttgaggttaatattattttaagggatttttctttctgttgcctttaaatcagtgcaagtggaaatagaatgatgttagaaaatgaaacattgtaaggttatgctaaaaacaaaattactacacaatatatttaacacattgatctattttaatagtaatatgtaacagtgctactattacaggcaatataatagttattttgtatatataatgttattttgtataccacatcttgatttctggtattacttgattttagacttttagaaacattcaaataacatttcattgtgatttatatgtaatactatcactgcaatatttatttatttatttatttttttgagatgaagtcttgctctattgcccaggctggagtgcagtgacccgatcttggctcaccgcaacctctgcctcccgggttcaagcgattctcctgcctcagcctcccaagtagctgggattacaggcgcatgccactgcacttggctaattttttgtatttttagtagagatgtggtttcaccatgttggccaggctggtcttgaactcctgacctcaggtaatccatccacctcgacctcccaaagtgctaggattataggcgtgagccaccacacctggcccatatttagagatatctaaaacatatgagagagactagactctttcattccaaaattcagctttaggcctggaattatttcctttttaaattaatttttttaagatgcaaggggtacatgtgcaggtttattacatggatgtattgcataatgctgaggtttgggtttctattgaactcctcacccaaatagtgagcatagtacccaataggtagtttttcaaaccttgccccaccccacttaacttttagagtccccagtgtctttctatctttatgtccgtgtgtacccatagtaaagtttcaggatacaaaatcaacatacaaaaatcagtagcatttctatgtaccaataatgttcaagctgaaaaccaaatcaagagcacaatcccatttacaatagccacaaaaaaagtaccaagagatacatctaaccaaggaggtgaaagatttctactagaactataaaacactgttgaaagaaatcatagatgatacaagcaaatggaaagacattccatgctcttggataggaagaatcaatgtagttaaaatgtccataccgcccaaaggaatctacagattcattgcagttccagtcagattaccactgtcattttttatagaattggaattattttctaactgaaaaatgtagcctaagaaaatattctctaaggcagtgataaaatagtaatttctatataaatatgaaatatttatatagaaaccactttgttaaatatttatataggaaaccactttaattataagcattatttcttttgaaaaatagaaagtgtagccattacttagttggcacagtagaaatcctttgatcagttaatgccttctattgtttgttgctgttttccagatcttgtcacaaatacagaagtatgataacttaataacacctgtagtagattcattgaaatacctcacttcactgaattatgatgtcttggcctgtatcctttcaagtgaagtaatatgtagatttcatatttaatagatcatatggtaaacgttttattttcattctattttcctttagtaaccatctgaggttgattcaggtggctgatctgaagtttggtcagtcaattgtgtgtgtgtgtgtgtgtgtgtgtgtatgtgagagagagagagagtgtgtgtgtgtgtgtgtgtgtgtacgtgtgtgtctttgtgttgtataaagggagacatgttaggcttaccaactttttttttttgtgtgtgtgagacagacttttgctctgtctcccaggctggaatgcagtggcactgtctcggctcattgcaacctccgcctcctgggttcaagcgagtctcttgcctcagcttcccaagtagctgggattataggcgtgtgctaccacacctggctaatttccttgtttttagtagaggtgggatttcactaggttggccagggtgatcttgaattcctgacctcaagtgatccacccaccttggcctcccaaagtgctgggattacaggcatgagccactgcacccagttggcttaccaaacatcttgatattgatggaatctgtcttgattgctgaaagatggaaagtaggctaaagaagaaatgttggtactacagtaagtgtatttttcaataattagttttagcaacatccctggtcttggaaaactagaaaaataatttgtaatgaccaacaattttgcccctatgatgtggcatattcatgttttaagggtctttattagagatgtaatgacttagttttttcttaatgtatgaaagattgtatcattgaagctttagctaatccagaaaaggaaagaatgaaacatgatgacacaaccatctcaagctggcttcagagtaagtatttttatttttccaaagatgaaattactatctgtggtaactgccatgttatgcattttattaccgatgcttagagacttttagaagcctatttgttaagagttgctgagaatatctagctactgagtttgttctgcagagcccttggctatgtaaggaggttgatatggtacttatttattttcctaacttaagagaccattattgactgtgatagaatttgggtaagcattactggggaggtgaaatctccttctttttattttatttttttttcgagatggagtctcactctgtcatccaggctggagtgcagtggtgtgatctcgactcactgcagcctccgcctcccaggttctagcaattctcctgcctcagcctcccgagtagctgggattacaggcacgcgccaccacgcccagctaatttttgtattttcgttagaggcagggtttcaccatgttggccaggctggtcttgaactcctgacctcaagtgatccgcccacctcggctcccaaagtgctgggattacaggcatgaaccaccatgcctagccaaaaatctcctttttaactaacattattttataggagttgatcgtaagggatctagtctcatttcttcccattccatcctgaggttccagtcatcttaaaagaacaaaaacttgacttagtttaaccaaaaaaactaaccatatttctttttaattcttgtacctttggtttctagcagccagttccttttctttcaacttattgtatctgatagcggaatcttgcagtggctccccattgtcctttaaagtccgaaatgtttaataagtcatacaagtaagttcttttgaaatcaggtccttttgcactgttctagcctcatcttttccctgcttcccgatattctagattccattaatactgaacttcttgtactttccatgaacttttgcccattattcacttgacttggaatacccttcatggcccactccatgttctgtttattcattagatttcagcttagaggtcacttcctctggaaagctttttctgttaatgctcccacccacaagtctgaattgggcgctcctcttttatattcccatggagccttttgctcatcatagttatttgtttacttttctgtatcttccactagactcagctccttgagggcaggacttgtgttttgtccaatatcatttaggtgcttagcaaatagttgtggaataggctgcagagcacttgactttacttgaatctcctactcttgtattggctggggtctcctccctattcatggtatgataaggaccattggttaaagttggtctcttgtctgcttctaggtctggtaatactttattttcttgcacctccacaactagtagcatgttccaagataaaaagagatttttttttttcttgactcacattcaggggctggcattttgtcatttattcaagtttactgagtgatctgcaagattttgttataacttagtttcacaaactctggaatcaggctgcaaagatttgacttactgctctactttgtactacgtgaccatgagcaagttacatgacatatctgttctgaatttgcctcatcaataggttataccaacctaggataatagttgcaaggattaaatgagataatcattataaagtgcttggtacagtgcttgacatatgtatgctcaataaatattggttattgttattattatgaagctccattcaacagcatcagcaatacaattattgctacctcattttgttttagaggtttagttgaaatgatacttgtgcattttgttttatgagttgtttttactctttttttattttatataggtctggctagtttctgtggtgcagtttttcgtaaatatccaattgatcttgctggtcttcttcagtatgttgccaatcagctaaaggcgggcaaaaggtattcatagcaaattatacataatgaaattcaatagagtacttttggtggtttggggttattgagactctgttatcccgaaagactacttatttgttggttgtaggctcaagtagaatagttgctcacttatttacataaaattctttagttaaatgataacttaatacataaatagacaccttttttcatgaataaatgtactatatgactatatatgttaatgcactaaaaagatactttcagttattttgactgcctattaggcttttgagtaaatggctaatatgatacattgtatatcttcgtataacaaaacatactgcactaggtcagtatgcagtaattgacctgtgtcacattgaacatctggtaggaacttgtttatcttgagggtgtatataatacctttaaagcataatttttgaatttgagttttagagatacataaggctttcataccttttggacaatgtccttttttctttataaatactgaagtttattttattttgggtcaatatcagtgcttagagtttgaattagtatgtatgtgtattaaacctcatgagaagtaaactgactagaatcaaagaacctgaattgttttcagaagctttctggtagaaagcaaacaaacaaaaaattaaaagctacttggtgttccaaacaagtattacctaagtaattattgacagattcttattttggcttagggaaaacttaaaaaaactttaaacttatgattttatgggcacatcccttatgctcatctctctgccatttctatatatttttattcttctttgtctataggccaggagaatatatatcattttttaatctataactcagctttctgtactgtgaatacagtttttgtgaccatctaattaaaacatagtttaaagaaaaaataaactgtttcattggtacttatatactagttttcatgagggctttctttaaaaaaaacaaacgaaactaaggaaagcaaggcaagttgagagaacaaacatttaataagaatcttagaaaatggttctttcgtctattagcttgtgtcttgggtatgtctgactttatgtttggaaaaacatctgtatgttttaggaaagaatgtttttactttgtttagattaattaaagaagatcttagaggacataaggtattatttccattggtagtcctaaactttgcagattaaaaagcataactgttggcacattactgaaatgtgctctgggctggccactaaattgtcatctttggctcagataccacaacttagaacttctttttttccttccttccctgcctcgcttccaagtgtatgtgaccatgctacatctttgtccctgtttagtaaatggattatttagaaatggctctataccatcaaaaacattttggccatcctgtattggaggagaaaaaatgctatgaaggactttattgggtcaactgataaaatgaaatatgaatggtagattaaagtattgtatcagcgttacatgtactaaaattgataactgtgctgtggttatttaagagaatagctctcttaggaaattcagtcttagaaattttaggggtagaaggccatgatgtaaataattttccctcaaatgattaaaaaattgagtgtgtgactatgtatgtagagaggggctccagagagggagagaaaatgcaaataatcaagcaggagtaaaaatgttaccaggtgaagttgaggtaaaggatatatgggtgagctttgtactattgttatttttccatcctatctgtaaatttgcaattatttccaagtaaaagttaaaataaacttacgcaccaagtatttgtcaatatagttctaggaatgcagttaaaaactgcttcagccccttcccccatatttatatacaaataattaagggtttctcagtatattaattacaatacattgttacttttatatttgaagttctaactatagactgtttcttttttctttttgaatagttttgacctgcttatattgaaagaagtggtacaaaaaatggcaggaatagaaattacagaggaaatgacaatggagcaactagaggctatgactggtggagagcagctaaaagctgaggtaagaattgctatttttgttcatcaacttttaaaattcataatgtatgcacggtcatagtaaagaatccaaacaatatgtaagtttataaaaccaaatgtcaaagccatacataccttcctttcacaaccacccctgccccccttttgaaattgagatacagtaattactttaactttttaaaaaagctgaaacaaagtataaaaggcagtaagtaatgcatccgtaaggaaaataattaccaaataaggccgggcgtggtggctcacgcttataatcccaacattttgggaggctgaggtgggtggatcacctgaggtcaggagttcgagaccaacctggccaacatggcaaaaccctgcctctactaaaaatacaaaaaattagccaggtgtagtggtgggtgcctgtaatcccagctacttgggaggctgaggcaggagaattgcttgaacccaggaggcggaggttgcagtgagccaagatctcgccatcgtactccattctgggcaagacagtgagatgctgtctcaaaaaataaataataaataaataaataaaataatcaccaaataattactatatcttctatgatccttgatatcctcactcccttaagtcttagttgctctgttgaatctgtgccatactgaataatgaataatcctttatgaggggactgcaaggtggaaaatggaaaatatgcagaaatttaaattcagttgacatttgtctttaagccagtgactgtagtcagtaatagtcactgaaataaatttgtgtaagggaaggaatgtggaatgtaggagttttttatattaagcattttaactcaacttttttctgtgtctttttcaaattagcatgggttatgtactgtacactggtaaatttgtgtcttcccttgtgcagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccaggcaagttaaagtggcttttatgtttatgtacatgtttttaatcctgttaaaggaggataatgtgttataatttgaaaaatgtcatttttgcacatcatttgaatatgagacatcctaatgtgaaagacattctggaaatagggcctatttctatgtaaattgtgatatataagagatagctccaagagatgttatatgtaaggctgtcaattaattaaatattacatcattaaattcctgcaacttcaagttgtttgcatttatatctttcccgatctctggaaatctcagtcataacagaatagatgcttgcttgcccacttgtgcatgctcactctcttttccctttttttttttttttttttttttttgagacaaagcctcactctgttacccaggctagagtgcagtgcatgatctcagctcactgtagccttgacctccctggctcaagtgatcagtctacctcagcctcccgagtagctggggattataggcatgcaccaccacacctggctaatttttagattttttttgtagagtcgggcctctgccgtgttgcccaggctgggttgctgtctctctttttctttgtgttatagttgatgatagttaaacacattttgtgggctaatcttaggttttggtacttaatatttataaatatattctgtaaataaagttttcttcttttaagggcaaaggaattgacttctgtttgcctatggttattattttatttgatttaggtaaatatattctactaaaagtgatgaacaacagcttgacatttaagagacctagttggctagtaaaaccttggattagtcaacctgtcagggccttggcatctttttttgtaatatggtcatgtggttatacttgtagatagtctctaaagtccttttaagttataaaatttggattcttaattgttaaaatattcctaaaatgacttcttaatcactttggaaaatatgttgattttgtcttattttttaaatttagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcggtaagtacaagtgtctttgctgccgctcaagaacgatccaaattatttcttaacggttttatctgtaagtacatatcactacagattttgggggaaggtcttggccctaaactaggatcccttctttgtttccaataggggtacgaagctgtgtggtagaggtatacaaaaaaggtgatgagaaatttggagtctaattgatcatttaatcaaacatctgctgttagtgtttacatatcaactgctacagtctcccacttctttcctaactaactgctacttgatttaattatcactttgttagcactatgcagaaattcctgtgttatgtatacactctgaagggaaaaagacaataagggagtggtgttaggctgcttcttcccctttagatcctctcaatccagagaattgtttgccgtctttgtgtaacgtcttactgttgtcacaccccatggtagatcagtctcagctgtgcaagagggtacctgatttcttgacagacagaggtgggagaatttcttcatcttaggaattctgacctgccctgtgctaagtgaacacactaatcagcaatatggaatcctagcaaacaggaacacctggttgtctgtggttggctgaacttttccagctcagaaaatggagcaggtcattcaagctactttttctctcttacttgtgtaaaatattacctttgtcttttaagagatacaaaaacctaaacaaagaaatggcatttccctctcaggcttggaagaaaacagaaaactaaatgaaagtggctgtatagccaagtcagatataagtcttttatctgtaggcagcatgccactctctggaaaaggtgtttcccagcaatcttgtggttgtgctggatgggcatccaagctgtcctggggatccttgcttttgcttcttgagtgaaagcctctgttgaagagccttcgttgagagagtgaaaatgtatattaggtgattgctatgtcccctctataaactatcagcaggctctcttgaggataattcagccaaacgctgcccagattttttttttttttttttttttttttttgagatggagtctcgctctgtcttccaggctggagtgcagtggcgcaatctcagctcactgcaacttccacctcccgggttcaagcgatactcctatcccaggctcccaagtagctgggattacaggtgcccgccaccacacccagctaatttttgtatttttagaagagatgagatttcaccatgttggccaggctggtctcaaactcctgacctcaggtgatccgcctgccttggcctcccaaagtgctggcattataggcatgagccactgtgcctggcctgctcagattcttgagacgagatttttgaacaatagtgagaagtacagcaataattgtggatatcagttctattccataagtctagttccccaggcaatttgaaatgtagaactgttatgtctcttcatttgactgaaggtgtgaacttgaagtgggagttaaactgactttagacaaggacatattcatcttgggtaaatacgaagtatagccttcttttctgaccaagcctatttttctaactagatagtgactatggggttcctagcaatagaaatcacagattcagacccagaggactggggagattggagctatcatgtaaccctctcatacctataaactaatttttagttttaattgttgaggttgtggtccaccttgagacacaggtctgaaagataggcttttaacctagttcatattctagatcttgcccagaacaggtaattaggctgtcttttatgcagataatgtcagccctattttatcccgttttgttagaaccttagcagaagtcattctgctcatctagattcatattagttaccttcaataagacctgtcctctaaattaaaaaacactctctgttttcccaactgctattccctcaggtttctgatgcaattgggactcctttttcgtaactaatgttctttgtagctttgtcacttacgtggtctcagtggttgtcagcatgctctctaaaatggggataacagagcataaatcttcccacttctagaacaattgtaaaattctagaacaattgtaaaattgagcactcaggaaggaaggcaggtaactgagctgtaaggagctgagactcttttgcctatcacagtgtagaactggaagcagaacctttgatcatctcgttttgggttacgtgtttagcacaaatagaatgatttaagtgattttctaacgtaaggaagtaactagttttaggacttcctttaggttcgtatgaagggtgatacctaacttaaacaaaattttctggatgagagctctttcatcctaaagagactgaaggatgtgaaacaatagcagcaactctgtgttatcttcatatatatgtgtgtgtgtgtgtgtgtgtgtgtgtgtgtgtgtgtgtgttcatgtataatatatatgttcatatatatgttatcttcatatatatagaatatatagaaaaaatatatatatttttgtgtgtgtatatatatgtataatatatttggcatacacatctctgcagcccctcccattgtactaacaattttttttcctcatacaattaagaatatggcattcctctgttttttcccccaaattaggataaaccagtcaaacgaaagaagctgcagcatcagttctcacatgctttaaacttcaatataccacagcttttcacagaaaaatttatttggcttagcagtagagtaaccagttggtcctggtttgcctgggatgttcccagttttagcactgaagtcttaaatcctcagaaatccctgaatccccagcaaaccctgacaattggtcaccctacttagcagtcttaaaacaaatttctcataacttttcttagtgttgatccagctttttttttttttttaatttttattttttgagacagtctccttctgtcatccagtctggagtgaaggggcatgatctcagctcactgcaacttctgcctctggggttcaagtgatcctctcacctcagcctcccaagtagctgggattacaggcctgcgccaccacgcctggctaattttttgtagagatggggttttgacatgctggccaggctggtctcaaactcctgatctcaagtgatctgcccgccttggtctcttgatccagctttttaattgacaaattttaacagttggtagggtctgcatgtagtgatactacattctgtcctagttggctattactagttccattcttcctcttttctcatgttaagaccttctatttgttcccttgaatatctcaaaagcaggactggaaaccctacatgttcaatccctgatacagcagcaagagggagtagggtgggggaatgaaagaggagaacatgcatataccctgttcactttactcaacaggtcagattagataagaaccctctgagaatctcctagttggcacacagtactaaagactggaatagcttccagagatgatttatcttaaaataaacgttgttcataagaaactagaatttctacaacagttttgagattggtcatcttttgattctttagaagggaatatagatttttatgccatgaaagtcaaagctataaattatgttgtgtgtgtatgtatgtatgtatttttactttttatctacagtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatggtaggtttttgttctagtagttcaagtgcaataactttatggtattcaatgttacctatattttgaaattgttttagctctggttccttaaaacagtgatcttgttgctatataatattttcttaaatggggtttaatagttacttctgagtggggggccaggagtttggtgactaggtggaggttatgattaatcaaaaattatttgagtgtccttttctactgacgactatgctagtaacttaaagtgattcatgtgactctaatagcaagagcagtagttctcaagaggagagttctttaggagaagactattgagaagccgagtcttgaaatggacaggccttgaaggtagattaggtttggaaatatggaagcagatagggaggtcaccatagggttccagcaaagacaggaagtagattgaggtttagggagaccacttttactgattcactttcatgtagtgaatgtacttagtgattcatatgaatagttatgatggggccagattatgtaggcattggaagtcagggagaaaagtagacttggtaaaattgagagctattttagattcctgagcaggatagtaatgtaaaaaatggtacttaaaaaagattactcatgacagcagtatgaaagatgctttttgactagcattaggctaaagaccagctaggtggctttttgggcagtctattgtgagagcatagactgatggaggtagtggcagtgtacaaggcttgtaaaccagtcttgatataaaggagagggaagagtcaaagatgacaccatgcctgagactaatagtgtcagtgttgcaaatgtagcctgttctgatggtgtatgaagatgccatgacagtgttatgagtgtgttgaatggagataaaagtagcacgttcaagtggacctatattcatgttaaagtagttataaactatcagcctttatctctttaaacttttcaattaaaagaagaaaggtaatgtgcatatagttagaaaagtgtctaattgaattctttgtagcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaagtaagttgttggaattgttaggttcctgatgctggtaaattacagaaaacaaaacattataactttagaggtgttaaagtgtattatgtttgtatttcaactcagtgttccctatcccattctttggttatttgttaatgcagaatcaacttcatgttcactggaggaactgatatagtttgctggtgaagttaattaacttttaactacatattggcagcttgtcattcagcttttctgtataaaacatatttctggagaaatcatagaaaaaaaggtccacatagtaaaaatgataatcatgaccaggcatgacatttggttacaaactataaatagtttgtggtttatagtattctcttcactaaaggtaatatgttgtcatgtttagtggctttgaggcacttggggaagaagtttaccacttaatatattcttcctttatttttagaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagtaagtttttattgcaacctttaaaaagttctcacacaaagatagctaacattataatttatagaggtattattgtgtgtttagttaaaaagcatgaactcaagaaccaagtgtctgaacttgaatcctagctctactactttctagctgtatgatctttggcaagttatttaacctctctgtgcctgttttcttatctgtaaagcataagtacctgcttcataagattgttgtgaggattaaatgaatcactacacataaaaagtacctgatatgtaataggcactcaaggttaaactattaactaagtatttgagtttacgtgttgtatcataataggtagaactctcttctccattcttaaccttcacttctcaaaaaaaaaaaaaaagacaaaaaagtttacaccttcacacacatataaaagcagggaagcttttcagtatggtcatatgcacattttgcatttagcttttttcttattactacattttgtggtttaaaaacataatgtggccgggtgcggtggctcatgcctgtaatcccagtacttcgggaggccgaggcgggtggatcacaaggtcaggagatcgagaccatcctggctaacatggtgaaaccccgtctctactaaaaaaaaaaatacaaaaaaattagccgggtgtggtggtgggtgcctgtagtcccagctactcaggaggctgaggcaggagaatggtgtgaacctgagacgcggagcttgcagtgagcctagatcacaccacggccctccagcctgggtgacagagtaagactcagtctcaaaacaaaacaaaacaaaacaaaaaacataatgtatgttccagtatgtcagctgcatatttttaatttctatcagcatttcctctgcttactctccccgtaaacccagtaatatgtatggctaagtggttaagaaactattatgtaataaaaaaaaaacaacttattatgtaataataatgataaatttttttttccttgtcactgtaaatcagctttctttataaaagttcttgttttgggtggttgttttatgaatgcattatttccccacaaaagccaaaatctccaaagttctctgcagtgtcattatataaagggaatatacattttgactaggcttacctgtttattatgacttgctgtaagagaatcttctaatatttttaactgattttgaccttgatttgtttatattttttaaacatttttctcctgtaggttttctctgacataatttacacagttgcaagctgtactgaaaatgaagccagtcgatacggaaggtttctttgctgcatgttagagactgtgaccaggtggcatagtgatagagccacatatgaaaaggtatgactaataaaaacccttatattttacccatgtatataatgaccacatccattaatatctagatagttgagttttaaaagagaagctgagtttaagattcagttgtaaaactgtgtttataagcacaattaatttgttattaaaatgtgctatgtacttttttattctatctcaaactgacattccaaattagtatctttgtataagttgaactttttgtgactacctatccaaatacgcatgatgtttttacacggaaacattgatctagtctacttaagtttcaatttctgctattttgtggatcataatttttctttaaaagtgacaaacattgtttccttaggaatgtggaaactatccaggattccttaccatattacgggcaactggatttgatggtggaaataaggctgatcaattagactatgaaaattttcgacatgttgtacataaatggcattacaaactaaccaaggtaaaaaaaaaattggatttttcaaaggcaaatttttctctgtatacttgtgcttttataataatggatctgaaaatgtttgttgtaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatggggtaacaaaattatattttaatgtgatttacaagactagatgacagaaggattctgaagactttaaaatgttttacagtgttgaagtttatcttctgccttcaggagattatgggagattatgcgatcatgtttccacaggctggtgagagttaccacttctgattatcaacttccggtctatactggatgatagtttttttaaagtcatgtataatatttcttgattgggaggaaatataattttatcatcatagttaacagatcttcaagagtaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactggtatgcttatttgtagaaacttataagtaatatattttatttcaacaaagtgaaatgttttgtatcacagaacgagtacaatgctggcttagtattactttttattccctagataggagtatataagcgttaagaagtaatcagcttgctgtttctttctaattattctctaatcattttgctctgaaattgtagcttatttacatttaggggcttgttaaataaaaccttacttttatttcagataaatcaagggagagatctcagtgtggtgtgaaagctgttaataaagcttctagtaccacacctaaagggaattcaagcaatggaaatagtggctctaacaggtaggaacactgtgccatgtgtcataattctaaattctttttaaaaatgatttttatgtatttttttgagacggggttggtcttgcaatgttgcccaggctggtctcgaacttctggcctcaagcgatccacctgccttggctttccacactgctggaattagaggcatgagccactgcacctggccctcataattctaaattcttctatgagtcctcatgagtagaaggggagtggttgttgagtaatgtgaaaagtcatttatgttgggctttgaaattttgtatgtaccctattttgctgatacgctttacatcctaattatgttttgtatagttatgcttgtataacgactttgtttctccttctgggatattcaggggaatgtaggtgtgaagttaaacaaatattttaggatagagggattgctgtgggttgaagcgattcttgtgcttcagcctccctagtagctgggattacaagcgtgtgccaccactcccggctaattttttgtgtgtttttagtagagacagggttttgccatgttgaccaggctggtctcaaactcctggcctcacgtgatttgcctgctttggcctcccaaagtgctggattataggtgtgagccaccgtgcccggctaatacatcttttaaatctgcaattaatgaatttgtttatgatttactggataaagaaatacttccttttttcgagaaggagtcttgctctgtcacccaggctggagtgcagtggtgtgattttggctcactgcaacctctgcctcccaggttcaagtgattctcttgcctcagcctccagagtagctgggattacaggtgcccgccaccatgcgcagctaagttttttgtatttttagtagagacggggtttcaccatgttgaccaggctggtctcgaactcctgacctcaagtgatccaccctcctcagcctcccagagtgctgggattacaggcgtgagccactgcacccgaccattacttcttcctttttccttgtcttaaagttgtcctttagttttcaaaggactcccccttagttctagtatttttgaagttagtaagaaaccctttatgatatattttatcatatatcaaaggatatattttatgattatttgtgttaaaatcccatgtttttattcttaagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaaggggcaagtttacctttctttatacgttcttacgttttgttattttaatgtatagttggttattgtctccttgttttggtaagttatataggggttttgctaggggaacttgtcatacaagttggtgtttttttttaagtgtttggaaaactagaaatgtaccttattctgactatttctttttgtcttaacagaacaaaaacgccgcaaaattgatactcacccttctccatcacattcctccacagtaaaggttagtatagcctgaggaaggcagcgtccatgttaggctcacctgtttggaataccagtgtcctgacttccttcaagtcttatgccaagcattcactggagccactggaggttttatattgcattagaaaatgaatttttctatattggtggactgattttttttcctattgagtatttttattataaaaatgttaaaacttcaaggacttagcactaattttgtagtgtttcaaagtgcaagagaaattttacccagaagtgcctcaactgctttaagcagtcttttttggagtgcaatggtagctacaagcaaacgaatcttttcagcagaatgaagcctatttttcagcatattgaagaatatatagcactgaagacttcctggatgacacaagataaacaagttacctctgaattcaagcttcttgatgagcatcataccgatgtgtgccttctaagaaggagtcttgaaaggagttccattttaaagtctccttggtgatcagttctcctgtagttgtgtatattcagtgagcatgcagcttctgttgtatcttcccttggaggtttgtttatacccattgggttcccaacaagttgaaccttgcgttacgataaaagcagatgtggcatccaatcctaccacccagcaaagagaaaccccaggcattcaactgcagcacaaaatcgtgggtgtagccttcttgaagactcagggtagccattccttgct

SEQ ID NO: 1219 - DNA, 77022 bp, mus musculus; identical to SEQ ID NO: 198

SEQ ID NO: 1220 - DNA, 11986 bp, mus musculus
gaggctgtccttagacagctcttctcatgccgggcagtttgctgcatctggaggagctcactggagaatctccaacatcggagcgggccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatatcttggggttcttatacgatgccccacaggagcacactcctgtccccaagggaagacaaaatgagggatctgggtccgggctaattttaagggacattgtgggacatgttatgggagggagagggttggactgctcatatctttttgatctttgggaataacagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggtaagatgacagtgatactcaagaatcaactccagctcctgagattcaaacttgccttccaggggagagtttgtttcacaaatgcatgcaagcatgcatcccacagttagtaaataagggcctactttgtattgggcaatgcagaggggggatgcagactctggagcagagataggagaaggaggggtggcaaacaaggatcatacagggaaacctcaattaaagtagagctctcctctgctgctccctagacagtactatccttgctttacctaattccagttcattctatccttccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaattttgttagtatagctttttattgaggatcaaagaacaaaaactgcctgtttgaactgagtgtatgaatgtttgttgtactcatgccctttcagcatagattccactaaaatacacttccgtagttacctgttcaccaatatcccccaccaaccagttcatgagctttttgctagcggagactgtgtcttctttactcatacacacctagacctacatgacgcttgatgcatactaaatgctcagtgagcatatgacagagctgatccttccttaatgaatagataagtgtgcctggcattggggtgggggtaggaaggagtggtaggaggtgaggtttgccctcactttcatgtaaaatctccttggagaaacaattcatggaaaggaatgtgtggccccataacaaagatttatttgggtcgcagacttactggccaaaccctctttattggcttctttcagtcttgttgtagaagtagggtcttaaatgagcttaatgtattcaaaagctctccttaatatttcagtggcattcatgctctgcaaagatgaaaacaatgttattttcagaggtttggtttttctggtggttgaaagaactacatttggcatttcaggggcctaaagatacagggaattatagatgtagatcttccactgagatacacccctacacatggttagagctcagtgaagctggcagattcttgagagagaacaggggcataagtgaatctacccttgattatgttacagaggcagagatccaaggaagggatagggaagagaaggtaaacttcagctaccacttcttgttcaaagaaattaagaaagagaaaacagaagacaacaggaaagaatcatcttgcctctaactttagggtctcttccgtttgtaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactggtaagagacgggtatgccatgaaacttaggttaacggctaaggatataaatctccctctgtgctccctggagaacctaatcctgtggccagggttaacagtagagaagggagcagaatttgtaaaactgggtgtaggcaggtttttccaagggtggtttggaggaagagaaggaaaagaatcttaaggagtgggagcaggaagtgaaatcactagtgctttttattctgggtctcatcctagacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtaggcaagtgttaacaactgtttttattatcaacctgtttgtttttatcatcattgtggtgttgtaagaaggagctagtagcctcatatcctctgagagctatgagcaaaacacacacacacatacacacacacacgcactaggaaggtggtgtagaactttcttccaaaactttagggaccttgtctcccaggattgttcctcaagctccacctctcagtatggcacagccccattgtaacccctgggaaaattatttttctttaggccagaggaagcttacaggtatgaggtcttcctgattgaaggtaaggaaccaggaatctttagatcaccaaggggtgggcaaaggaattctaatgcacagtcaaatcttgaagccactggccaagtggaagtggaaaggaagagaagatcaaatggggagctcagaaacattttctgggggagagggtactgggtttgaggtcacttctcactctggtctctggattggtttcagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggtgagaggataactcttcagaggaatgcccctccataccccagggatcccagatcagtgcccagaaagatatgggaaagggagtcagaggcctgaaaatcagagcccttgggtttcagcacccttcccctggggtggtctcacaattcctcaaaggcagttagcaggataatttcaaggctcccattctccatgaaaaagaaggccacttctgcctcaccttctcaatataagcactgtcagtaaccagattgtcctcaccccatgaatgtattcacctgcccctgtccccatcaaggcctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccggagggtgcccaaatctcgcccacaaaccatcctgccctcagagatgattgatgtctccctcattaacttgttctggatttttcctcttgtaagaagccatgctgtcctgtctcccagactgttatccaactcctatcccaacttttcacccttatccctagctctcaggagctattaagccttgtgacgcatcctagttgccttagtaaccagtctctgacactgtggcctccaaccacctgtgcagagcattctgggaatatagacttgacctggatggccatctgatgtgatattggacggggcaacagaatcagactgtttcctctgactcacaaactcacaggccaaacagattctcctgccatttcctttgattctgtggtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggttagaaaaaaaaaaaaatgtagctttatgtgccccaccccagcccagcaacactgcatcaaagaataagatcaggaaccagatttcagagaaagcagcttgaaaatcatgttttcctcaccaggaaggatggtcagtgttttctaagtaaaaattgtccgatggattttgggttaatatcatctaatactacaagactcatgacccaaagctgctgcacatttctagttataatctgggtgaggggagagtttctactctctgaaaagcttggctcggcactgccaatcttctagtaattcatcacagctgcctaggcaacccttccataacaaaggcaggtgaggcaggtgggtctgaggaccaatactgccacaacaactgcttccgaacttaaacttgatgactgagaaatactcacagtttctccctccacccccacacacaccacccagagctgccgatcacaatgagctccaggggttctgagagctccaaataatataaaagcattttcccatctgacatctcaattccagcaacaacctaatcaggggccatggggagctgacatatgatataggctgcggagtggggagggggcgggggggacacgtgggtcatgaaagagcaagaggtttgtaggtggtaaggccctcaaaaagaaaagtcattgatgtcaaataagattatatcccattatcttggccatatccagtccccattgggtagcgagtaagccaatgacataaattgccgccccctttcctccaccctccccctcatcccagcaactcctctcatctcttttctggtctcactagagaagcctggttgctgggaacagctcaaggggtcaccatgctcttcatagtcacggcccttctctgctgtggtgagtacaagtgggggaaggggccccgggcagaaggccggggtgaagtcccggtgggggagggggccgagtcctggcagcaatttcttttgcaggactgtgcaatggggtattgatagaagagactggtgagtttttcctgctccagactgggacattcctccctggagatccgaaataactacagagcgtcagtgtcattggccagggagtggctggttgggagggaagggcagccaggaaggggcacttgctaaagctgctggcaaaattcagcctccaactttgcctttctgcctgcaaaatttcctccaagcttctgcacttttctgaggctcagctataagacaccagcttcccctttccccagcacctgaggaaggaaggaaagaaggaaagggtttggatttgggttgcaaggggaggtgggcagtgtgatctgggtagagggttcaagggcaaggaggagggaggggaagggaggcgggaggatggcttcattaattctgctgtttctagaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacaggtaagaaaatgtagagggtctccgggagttatccccagtgcccctgggactccaacactgctcctgggagtgagggaatgaactcacagggaccctggagcccaaggggctcgtgctgcatgtaggagaggaggggcactgaaatggtagggggttatggggtagggggaggggcggaatgggaaagagagtgtgaggagactgactggaagagcctagggccagcccagaatgaatgtctttatttgctgacaaagtgaccctgagtatcccatctgggcaactgcaaacttctgactcctttttcaccccattctgttttccagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaaggtagagctgaaaagggtgtgggaggaaagggggcagggtggagggaaaggcaaagccctgggtcagacactcctctccctgcagcaaactttgctgctggtcctgagagcctgtgtccaatcttagagccaggcaggcgtggcgctgggagtgccagggcctctggctgcacgatattaatagccataatcgttattaatagctttggttcgtggagggtgatttaatttttctaattattttcacatcaattatctcacttcaccatagagcaactcttcaaggtgggtgaagcaggtaccattttccccttgtccaaatgggcaaactgaggctcagagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgag

SEQ ID NO: 1221 - DNA, 211 bp, mus musculus
cagggcccgcggcgcgctcgggacgtatcaacgctctgtgggtcgtgtgcgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcct

SEQ ID NO: 1222 - DNA, 195434 bp, mus musculus
gctgcgggcggctggggggcgggggagcgcggagagccgaggggggcaggcggcgagcgggtggcccggccgcccgcctcgctgctccgcttggcgccgccggcccacgccgcagtgtgttttgtggacggcgccttcccagacagcccggtagagcccagctcagcgcccggcagccttcgacgcgatgttccgccggagcttgaatcgttttgtaagtacactcgctgcggctccgcgcgtgccggtttgcttgctcgccagccccttcgccgggtccctcacaacaattttctgagggggcagttacgtctctgggagacaccaccacccctcttcttccttttcaccgaaacacggtgcccaggcggccggggaggggaggcaggtagggctctcggggtatcccaccctcgcccccaggacaattcgaccagggcttcccggagctgttacaaactctgcctgaaactgggggccgccttcgggctgggtggtgggggggactcgtggggggaccgacccggggacccctcagtttgccaattagtcgaagatggcgttttattctcagggaggttgctttcttttgtttcctctgccacgagcacatggaggtaaacctagacctgtcacggtggcccaaaagaagagctgggggctgagggagccggagactagggcaagactcagccttgcctagggctcagccagcgggcggcttctgaccggaggccgggcaaactttggagacccagcctacaaagctcacctttagggtgtttgaaaggcgagcgtgattgtcagggtgggccgggtggatgtgcagccgcgaggaggctgcgccgccactgcccgtgctgccgatctctggtctgaagcctcgcggaggactgagcactccagaccttgaacccatgggagaaggcggactgtgactggactcctccgtccacgtttacccccttcagaatccccagaaaagggaatttcattttcatgggagttagccatagggaaaatcgctttctggctactgacttttttgagtaacctgtttactcctagagggtacattaagaatggagcgaaacaggaccatttacgttccgtgctgctatttgtagcaacttccttaattgcaagaggtggtggcgggaataggattttatttctgccaatgatgtggaagaaagggttcatctgcaaattttgatttttctgtagttaggaaaaagggttgaaagctgagtgctttcctctacctgccttaaaatatatcttttgagaacatgtcgatttggttttattcatgcaattattcctaatcaaaacgttgctaacatttttcatacatcggatatatttgctctcatttttccttcatttgaaactttcacaagtgtacactggctaaaagtaatacttgcacatccctttttagaatagtgctgtgttaatggttttctaaatgttgaccccacccaggaacatgcagtatgaaattggaacagattattacctgtggcatagagcagtagaggttgtacatatcaatcatcttgaaatccgtaggtgatggcttgtactgatagctttgctgaagcaagtgactaaaattggtttctcacatttagcctgagaatgcaagcgggtattgttcttaatagctgtttcacatagattcttgtgatcttggagtgttgcgtgggggtgacaaaaagggaaaggtggcaatgaaagctaattgtatttaggaaaaggataatcttttcacgtggcactcttatggtggaaaacaactgggctctgaatcataataaaatcattaaacttaagttgttgaaatcctttttttttttttttaaggatttgaacatttgaaaccgaacaactcaagtattggtctaaaagcccattgcttcccttttgcgaaaagtgatctgcatcgtatcagagtctagtaattaagcagtgctggcccaggaagccagggcatgcagtagaatttgcagcagttgttgaggtgccagcctgcaggtttgaggctagtactttgcatccccgaccaagatctcagcagagaatcacttttgctaatactgaaatgagctttgaccttattgttgcagctggaatattcagctgttcacattttcctgcgcagccatgactgtggtaagtatcaggaatttgtaccagtgcggtaagctggaaggttcttaggagttgtgtctgagccctaggcccagggcaaggaattaatctgcataccgttggactgaatgtgaaaattactatcaaataatcattgctaaaaaacggcttcaaaatttgggggaggggggcaatttttccatctcttagatcagtaaaccatgcgctgttctcctcttttgcctgacaaattctttgaggggtacttccatttgaattactagaagactagaattaaagatttgagtggaactttgagactttcacagcagtatagatgtagtcaaggttgtgagttgtcttatgattgttttaatattttagaaatagagctatgaattcctttcaaaatgagttgtttttttagtgtacctgtacgtgtctgatattggttttgattgtgaaataaattacagtggtgttgattgtagttgttggttattgaaaactagactacatattagagaagtgcttcctttatattttaaacctgacgtggaagaatcccttaggattcttacaagcatcatcttctatagctcagttgtgtttgctgaatcatttttgaaatgccatttatttttcgagttttccaatttcaagctaaaagaaaatagtgattcattgtatttttttaaatacatggtcttgacttctttgccattaataactgtgttcctttctttctgatgaattatgactttccttttgacagttttgaggtggaaagaaattggtggatttggtgtatagcattttagggttgaggcatgtagagggtgtcctaaaggatttaagagttggatgtctctgagtgcaataaaagcaccacctgttctcaagtcaacatctccataaatacagtaaataagtaataataactctgtctgtacaatttattttcttcaaaggcatatttaatcagaagtctggactagttgagatttaagggtcatggacttttatgttatcctgtcttgttttattcttaatgcaattcctagtgactatagtaacgtgttctcttgggtttaaagatttattgaaagtctaaaaacaattcccccctctttttggcttatgaaattattttatactaaagattcaaaataagagatttcttgataaagtaggttgggggcttggtcaagaggatgctgtcagtttagcttgtcagtgatagttaacaggtatgcatttctagacctttgatacatgaaagcttaattgtgagtgtgaaatactggagtacatttaaatctctgattctagaagcccttaaactgctttggtttcataaagcatgtagcatataatcataatatcacacagaagatgcccaggactaggaagaaattagactgcataaggaagaatggaaatttaaaataagactaaaaaatacaaaataagaattaatgaaataggtagctaatttattgctttgagtccaaggcaaggctagtctaatgaagcaatatatggaggcaattaagaaaatagttcaggtaattgctttgttttttccccaggagcaagaaggtttttagtttcccctttaaactatcagagtaattaaacatttttttttttctgtttcactttactaataatcctggcctgacattgacgagcgggaaaatattgattttattttactgtgtttagaaatatatctgtatgtatgtattgcaatatttttacatttgcacaactattacaaatggtctgtgtatctcggctcccacatggctgttcatagaggtctaggtttagcagttgaacttgaccatacttaaaagcaactttttttttttaaatcatattgtgttataattgccttttaacttgtatggctccctagtctttctcaacatggagagaattggcactgatgccctaggacatgcattgttagtaataaattaacattttcctgcgcagctggagtgaaggaaccctaattgagaaaggctgtcctagacagggacagttcacagtgtgttcttagctcctagcacagtgcctggtccctagtaggtgttcagtaaaatattttttgaaagaacaacttttgtatgtatcccataaataataacctttacttacagatagtgattattgtaaacccgctcttatgcagaatgagcaaagaatgagttcttgttagttggggtataccgtatacattactagtattctaagaattagaataaatacatctaatgccgaaagctatactgaccatagtataatctttttttttttccttttttttgagatttattatgggaattggatcatgcagttacagaggctgagaagtcccaggatctgccatctgcatgagcccggccacaaaatatccccttcttttatttatttttatttttattgttattttttttgagacagagtcttactcttgtcatccaggctggagtgcaatggcacgatcttggctcactgcaacctccgcctcacgagttcaagcgattctcctgcctcagcccccctagtagctgggattacaggcgcctgccaccacgcctggctaattttttgtattttttagtagaaacggggtttcaccatgttggccaggctagtctcgagctcttgacctcaggcgatttccctacctcggcctcccaaagtgctggaattacaggcaagagccagcatgcctggcctctttcttagatgattaaggcattgtatggttttgcagagcaattatcattcagcaaatattcactgagcacctactatgtgctgggcactgcagtcaatcctggggtcgtagatgagcaagacagacaaggttcctgtcttcctgagctgtaattatcattacatacacaactatagatatagagggcatggtaactgcattgcattgaatacatttgtgacataccatgaaatttgatctttgtgaataagttactattacatacttgtcatttttctttctactaaaaatagattgtacaatatcagttattttctggttgtttggatgtcagttaaaaaggagtttcttgcatttgtctcctttcatctgacctacgcatggcaaactgctcttttgcaaatagatgctaggctgaccccacgcaaggtgggaaacttatttagaaatgaaccactgtaacttgaaataaatctttacacaagtgaaagcaggttttgtcttcttttttcctgatctaccttttagtgactaagcaacataaaactctgaatgtgtcctgaatactttctgtaagtgtttactgtttgttccttttgtttatgcttattgctaataattcagccatttagtgagtaatattgagtgcctatataccaggtagtttccagtgttcctaattaacttttagctgaattgagatttgggcaggtgaagctggccatttttatattgatgcaactgttcaaaagagcttgttttttcaaaaagctgccagtttaccacctgctgagcagtgggttctaggaggtaaaggatggccagtggcccctgaaagaaccataactaaccttgctgtgtctgcatgatgtgcaaagaactagcccactgagtgaaatcaaatactggtttgttgagtgatggaaaaaatcaaggctcattgcttgtctaacatggttattcagttctctcaaagagggtgaatgcatgggatataaaaaaaaaatactatttttttcttcaaggtggtggaatttcctgtacatctgtagtgctttatacagatgaaccttttacatctggaaccctcgagactgggggagtttttctggttaggtggagggaggttctgggcttccacaaatgaattaggtgctggctctcgagtttatttcctttcacttaacatttaccttcttggcctggtataagggtagattagcggtgatcgtaaaacaaaacatactggcacaactgcagcatatgttaacactgctgcagcttaatgatgaatgagtgctcagcactgcagatatgggcacaggatgccctatgcccacacattggcagacagcccctcaattattgcagtgtatggacggattactgggtcggctgacttcttgataatagaagatgtgatttataaatgataatggaccgtggatttccagatttagaaggttaacctgtatttgtgaagtagaaatcattgatttcttgtgccatatgtatttaatggaatatgggaggattggtgatgttgatgatattgctgttcaagcagatatcatcatttgttttttagacgtctctattatatgttgtcataaagtattaatgtggcaatgttttcctagtccctttctctttaccaaggtattcttggaaaaatcagaagtgttcttgaaaatgatcttgcagttagcacagcatcaggtaaacagtagatgttcaattaatacttgtttaattgttttgagctgaattggtaacacagtctgagtcagtaataacagatgaagaatgatcagtttaggaagcagccaccaagaagcttatgcatttcagactgggctacaaaattagccaggagtggtagcacaggcctgtaatcccagctacttgagaggctgaggcgggagaatcacttgaacctgggaggcagaggttgcactgagccgagatcgtgccattgcactccagcctgggcaacaagagcaaaactccatctcaaataataataatcctgtatgcttactataaatacagattcctgggccttgaacttactgaatccaagtcttgggtgacagactccaagaaactgtttttaacaagcattccaagtggttcttaggttcactaaaatttgagaacagcaatatataatatagtaaacacggaaatatttattttctgggcacactctctgttcacctttttgaacttcagtttcttcatcgatagaatgggaataataatacctatttcacaagactgttgaaaaaaacgtttggtagactattcaacactataccaattgtgacagaggtcctcaaaaccggcctaggtttgttgattcactggcagaactcagtacatagaaacgcttgcggatgtgatttattatagcaaaaggatacagagcaaagtcagtaacgggaaaaggctcattggggccaagtctggaggaaaccatgtgcaagcttccagtcctctttcactgaaatcacacaggtcatgcttaattcctctagcaaatgagttttgacaacttgtgtgaaatgtctactagggaagcttattagagattcagtacccagggtttttagtgggagctggtcacacaggcaccctccacctggtacacagcaaaattccagaccccaaggaggaaagcaggtattcagtgtaaaccctattgtttacacagcttaagcagagtgagccactcttatcagggtgatggaaaccctcccaaaatccaagtccccagacaccagccaaggaccaaccttgcaaacaggccttactaagaatagcagtgtcaggcctgctatgttaactctttccatcacgcaaatattgtgaaacactggtattttttcagtgaaaggaaatgacttgtccaagatcattaagctaatcagcagtacagctgagacagactcccagcaatcacatcttttctttgctgcccatagccatgcttctagattatgggtcattccttttcatactgtcattgaaagcacttactgtttgtcacttgaagcagaagagcagcctgccggtggtaaattgatgcacccagtgggggagccaggaagtattgatgtttctgccagtttagcgtcaacacttgctggtttcctctctggagcatcgccaagttcgtggattttcatttttcctgacttttggacttttgttactgctcccattcatttgctcatagtcctaatactcatttgcatcatcacttcatcccattctataccttttgggtaacacaatttccaaatggtgggaatactgcagtattttgtcaaagaagactatataggaaaaaaaaaattctgagcaatgaattttatggcaatatttacaaatattggtttatatcctggattgtcttttgagttttatagtcatggaaaaccctagggatatctctggttatttggagtttcagccatttttactgttataaaggaaaattaacaaatttgttatgattggagcaaggaataaggaaatcatactggatggtgcagtaatcccacatatcgacagggagtagaagccaggagggaattgccacaagtaagtaacagctgggtagagcagattatgtaagctacacctgttgtgtaagcagtggggacgttctttaagcttcacaattaatgtattttgcagtaataaggattaagggatctatagtatagtgtacaatttattctggcttcttttctgaaaacattcatgtgaatcacagctttcttggaacactcatcccctatttggtgctgtagaggtgtgtaaggtacagccctgctcaccagtagcctgcagtttggtagaagagagagaagaccagcacacaggaccatcctccacacaaggccagtaggtcaccagagccatccttttgaaggacatacacagtaagtgcagtaggcattcagaaggaggcactggctctctggcttcatttcttggggagagctttatggaggaagtagcctgtcaactgggcctctggggacccaaagggctgaaggttctgagattttagggatgggcagtctcattacaggaggaggcaattacctgagcaatggtgcagggtcattgttgtacttaaagcatgggaaccagtcaatttagagaacatacatgccaaccccaaatgagtttgagctgttataaaaaaaagtataacaggtggggctcagtggctcacgcctgtaatcccagcactttgggaggctgaggcaggtggatcatttgaggtcaggagttcaaaaccaggctggccaacatggtgaaaccccatctctactaaaaacaaaaattagccaggtgtgatggagagcacctgtaatcccagctactcgggaggctgaggctggagaactgcttgagccagggaggtggaggttgcagtgagcagagatggcaccactgcactccagcctgagtaatagagcgagactctgcctcaaaaaaacaaaacaaaacaaataaaaagtataacatagattcagtggcttatgcacaacagaaatttatttctcacaatcctggaacttggaagtccaagatcaggatgccagcatggttgggtactggtgagggggcttcacgtcgcagactggtgacttattgtatcttcacatggcagaaaaagagtgaaatgagctccctagggcactaatcccatttatgagggctccaccttcatggcctgatcacctgtcagatgcctcacctcctagtactgtcaccttggaagttaggatttccacataagaattttaggggaacacaaacatcctgtccatgacacagcagaaacaccaaaacctcgatcttcaatgccttacgtttgctgtagtaattttgattttaaaaaaggagatgctaaaaacaggtggctttaggtctccacaacaatagctataggaatcttcccatacatagatgctcttttctgaaacctatgactccagtaaatttatgtcatttaaaaaaaatgcatatatatatatatatatatatatatatatatatatatatatatatttagagaaggagagagagagagagacagtcttgctctgttgcccaggctggagtgcagtggcacaatctcggctcactgcaacctctgcctcctgggttcaagtgattctcctgcctcagcctcctgagtagctgagactacaggcgtgtgccaccacacctggctaatttttgtatttttaggagagacagggtttcaccatgttggccaggctggtcttgaactcctgacctcaagtgatccacctgactcagcctcccaaagtgctgggattactggcgtgagctgccatgcccggccttatttggtgcagagacagtaaggcagagaccaggatgaaatatatatttggggtaatatatcatgacactacttcatatattattataggactgcttacttagttaccctgcttaaattatgggtacacatttctggtaactttcactacacatgggagacaggatggcagttcattttcttgagtactagtggtcatttatttaaaaagctggagatcaggccttttttcaggagcacattccttaccaacacatttatagttcactgctattagataagaaagcttttgatagactttcagatctgactgcatcattcggacttaccagaacatgaattgcatctcattccctctgtattagtctattttcatactgctttaaagaactgcctgagattgggtaatttataaaggaaagaggtttaatggactcacagttccacatggctggggaggcctcaggaaacttccaatcatggcagaaggcaattaggacgcaagacaccctcacaaggtggcaggaaggagaagtgccgagtgaaggggggaagaggcccttatgaaaccgtcagatctcgtgagactcactcactatcacgagaacatggggaaaaccacccccatgattcagttgcctccacctggtctctcccttgacaggtgggtattatggggattataattcaagatgagatttgggtggggacacatatcaccctcataaccagttcatcacgacaccatgcttagtcagtgccacttttctttatcatcatgactgccaccctcgtctaagtcattagcatctctccactttcatatttgttcctcctccagttttcccgttcagtaaatggcaccatccccctcctagtagctcaagctaaaaacctagcagtcatacttaatactaacctttcccttcatcacatttgtcagagaatccagtaggttctatttctgaaaatgctgtcacatccatccacctttcttcatgcccacacctaccaccattcaagtttaagctactgctgtcatttacctggacctttgcaattgattattttattatccacctttgccctctcctatctgtcttccacacagctccagggggatcttttacagacgcacaccaggagcacttcattgactttcgactgatttctggttaaatactttgctggtattgctctctctctttcactttttttcattcacttttaaaaactgagataattcacctaacataaaattcaccactttaaagtatacacttaagtggatttaaatttcctatgctgtgtaactatcacagctatctaattccagcacatttccactacctcaaaaagaaaccccatccgttagctcttagtcccagtcctctatccttcagcccttggcaaccacccatctactttcttatctctggattgccagtggaatcatacaatatgtgttcctttgtgactgaattctttggtgtagcatagtaatattttcaagatttgttcatgttgtagcatgtatcagtatcagtacttaattcttttttttttttttttgaggtggagtctgtcacccaggctggagtgcagtggtatgatctcggctcactgcaacctgtgcctcctgggttcaagcgattctcatgcctcagcctccaaagtagcttggactacaggcacgcaccaccacactcgactaatttttgtatttttagtagagacggggttttgctatgttggctaggctggtcttgaactgacctcaggtcatccgcccggctcggcctcccaaagtgctgggattataggcgtgagccaccgcgcccggactcattccttttgaaggcagagaatactccgttttatggagagagcacattttatttatctgttcatcagctgatggacatttgggttgttcgcactttttgactcttgtgaaaaatgtttcttcgaacatttttgtcctttcttttttatttttttattgagacagagtctcactctgttgcccaggctggagtgcagtggcgccatcatggcacattgcagcctccgcctcccaggttcaagcaattctcctgcctcagcctcctgagtagctgggacaacaggcgtgcaccaccacacccggctatttttgtatttttagtagatatggggtttcaccatattggccaggcttgtctcgaactcttggccttaggtcatccgcccaccttggcctcccaaagtgccggaattacaggtgtgagccactgtgcctggcacatttttttgctttttaaaatgaatatgtttttacttgagtatatattagtggaattgctgggtcatatggtaattgtatgtttaaacttttcaggaactaccaaactgctttcttcagttcttcctcacttaaataagtagtttgtgtgtgtgtgtgtgtgtgtgtgtgtgtgtgtgtgtgtgtgtgtgtgtttaagtttgagtgcagtgctgcgatctctgctcactgcaacctccgcctcccgggttcaagccattctcttctcagcctcctgagtagctgggattacaggtgcccgccaccacgcagctaatttttgtatttttagtagagatagggttttcctgggattataggtgagagccactacgccagccatgtgtgtgtttttttgagacagagtcttgctctgtcgccccggctggagtgcagtggtgtgatctcggctcactgccatgtctgcctcccgggttcaagctattctcgtgcctcagcctcctgagcagctggaattacaggcacacgccaccatgcctggctaatttaaaaatatttttattagagacagggtttcgccatgttggccaggctggtcttgaactcccaacctcaggtgatgcaccctcctcagcctcccaaagtgctggaattacaggtgtgagccacagcacccggccaataactagtatttttaattgtaaagaaaacacctaaaacttaccatctttctttaaagcatagagtagtgcaaattgtattcacattgtatgcaacagatctctagaactttttcatcttgcaaaactgaaactccatacccattaaacaacagctcccccacttcatgcagtattggtctttttgtgactggcttatttcacttagcataaagtcctccaggattctccatgttgtagcatgtgagaggattttcttccctttttttttttttttttttttgaaatggggtttcagtctgtcacccaggctggagtgaagtggagtggtttcgctttgtcacccaggctggagtgaagtggagtggtcttggctcactgcaacctctgtccccacccccacccccgccccgggttcaagcaattctcctgcctcagcctcccgagtagctgggattatatgggattatagttacccaccactatgcccagctaatttttgtatttttagtagagacggggtttcgccatgttggccaggctggtctggaacttctgacttcaggtgatccacccgcctcggcctcccaaagtgctgggattacaggcgtgagccacatgcctggcctgattttcttccttttaaagactggattatgtttcattgcgtatatatatattttgtttatacattcatctgtagatagtcatttggattgcttccacctcttggctattgtgaataatgctgctatgaacatcagtgtgcaaatatctctcttcgagattgtgctttcaattctttggatatatacccagaaatgagactgctgtgcatgtggtaattctgtgtttaattttttgaggaacttctgtactgttttcaacagtggctacatcattttacattcccattaagggttctagtttctccatatactcaccaacaattgctatattttttatagtaactgtctttttttttttttttttttttttttttgagacaaagcctggctctgctgcccaggctgaagtgcagtattgcgatctctgctcactgcaatctctgcttcccaggttcaagtgattctcctgcctcagcctcccgaatagctggaattacaggcgtgtaccaccatgcccagctaatttttgtctttttggtagagactgggtttcaccatgttggccaggctggtctcgaactcctgaccttatgtgatccccctgccttggcctcccacgtgctgggattacaagtgggaaccaccacgcctgacctataatagctgtcttaatgggtgtgaggttacatcttattgtgattttgatttgcatttcttggatgattagtgatgtgagcatcatttcctatgttttttggccatttgtatgtcatcttttgagaaatgtctacctaagtcctttacccattttggttgcgggggggttatttccttttttgttgttgctcagttgtaggagttatttacatattctggataatatttccttatgaaatatatgatttgcaaatattttcccacattccataggttgccttttcattgtgatgattacttactttgatgaacagaagtattaaagtttgatgtagtctcatcatttgtctgtttatgctttcgttgcctgtgcttttaatgtcatatccatgaaatcactgtcaaatccaaatgtcatgagtcttttcccctctgttttcttctaggagttgcatatttttaagtttaattgatagtttataagtcttacatgtagatcttcaatcgactttgagttaatttttgtatgtagtataagataagggtccaacttcattcttttgcatgttgatgtccagttttcctggcaccatttatttgaagactctcccagcatcgtaggacagggtaagaaaaaaagagaagactcttttcccccactgagtggttttggcacccttgttaaagatcatttgaccatgtacatgagagtttacttctgagatatttatttttattctgtttgcctgtgtgtctgtctttacgccagtgtcacgtggttttgattactttgattacatattgttttgtaatatgttttgaaatcaggagttgcaagacccccaactttgctctttttcaagattgttttggctatttggggtgccttaagattccatatggattttatggtggatatatattttttttaatttctgcaaaaaaccttcctcattttttgtgttccatctgccacaggaccgttgtatatactgtatattcctggtacacttctctcctgtagtcagttgtctcaactcttacttatttctgagagctcagcttaatcatcacttccctaaggaagctgttcctgatccttccctcagacaatgccaggttctcatgttactatgaacctgtccttcatactctttttgtagttgactttacatttgcatactgtatttggtaacttacttagtgtctagatttcctctatatagtatgctccatgaaggtaagacctgtgactatttttgctcattgctatatccctaatgcctcactgcctgacataatatgtgctcattaaatgcttgctgaataagtgaaatacgatttctatttgcatttctaatcttcccatttataattatagacttgtagtgcttgactgagagatcaaagactaagtgatgtccagtcttttttttttttttttaagacagagtcttgctctgttacccaggctggaatgcagtggtgtgatctcggctcactgcaacctctgcctcctgggttcaagcgatgctcttgcctcagcctcccgagtagctgggattacaggtgtgtgccaccacgcacagctaatttttgtatttttagtagagacagggtttcaccatgttgggcaggctggtctcgaactcctgacctcaggtaatctgtctgcctcggcctcccaaaatgctgagattacagacgtgagccaccgtgctggccacatgttgtgttttataatacatacatcatgcctttttaaattatgattttagttatttaatattctgtgatgtagttaatgaattaactctataagcttcactgtggtttcatacacatttacaacattgattttcttcagcaatttgctattatattttcaaagtacttaacgtactcctaaaatatgtacaactattatatatcaattaaaaaatactccagtataaataccaaatgaagtgtttattaatcaaatatttttttttctttttctttttctttttttgagatagagtcttgctctgtcacccaggctggagtggagtggctcactgtaacctctgcctcctgggttcaaattattttcgtgcctcagcctcccgagtagctaggattacagacgtgcaccaccatgcctggctaaattttgcatttttagtagagtcagggtttcactgtgttgaccaggctggtctgaaactcctggcctcatttgatcctcctgcctcggcctcccaaagtgctgagattataggtgtgagccactacgccaggtgtaatttttaagtccttttgataactttttgtctatgtgtttttcaaattcttgtttcaaaatttgtttttaaacagctttatcgaggtgcaagtacttttaatgttattatttttgtgagtttattgcaactttagggggtaccagatattcagcaatgatagtagtgtctcatttaagtccttattgcacaaagatggagctaatctaattattttatatgggtcaagatttgaaatttttaaaaatcttttttaaaattttactttaggtgtaggcatttgtgttttgtaggatatcttgaattgctgatccatgatttcattgatatgttgcaggtttatggaattgttatagttgtaagctgtttttctttgccttttaatcatcataacagcaaaacctagagtggtaagttccaggaactgttttaagtgctgtataagcattagtttattatacacatttggttattaggattctccagagaaacagaaccaataggatatatacaagaagtgatttatcataaggaattggctcatgggtttatgtagcttgacaagacccaagatctgcagtctgcaagttggagacccagaagaactgatggtgtaagttccagtctgaagactggtaggttcaagactcaggaagagtcactattcaattctgaaggcaggaaaatgcaggaggagttattccttagctgagggaaggggaagggcagcctttttgttctactcaggccttacactgatttgatgaggcccacccacattatggagggcaatctgctttactcagtcttctgattcaaatgttaatctcatccagaaacaccttggcggacacatctagaataatgcttggccaaatacctgagcatgctgtggcctagtcaagttgacacataaaattaactgtcacatttatgtcctaggatcatgtgaagatgaatgaacaaatctaaagtgtctataggccaggaatggcagactctactataaataattgtagtttgctagacttcccatctgtaaaataaagggcttgggctgctagatggtctgtaaggctcagtgaatcctagaactattaaagaaccttagaggccatttagtagtccaacatcttcattatagctgggaaaatggactgagagagggtaagtggcttttccaagattattcagtgaattgagaattcagaaatatggaattccaggctcagttctattgcccttgtcttcagtttccttatctgtgaactgcatgggctcctgggatgatatatatctaagttatttcccagctttataattctgtactatgtgtttaggcttagagtctacgagtgagcgaatcttttgactattttctgttgggtttttatctgttttactctttgggtctccatctcttgattgcacatttgacggtattctaccccaaatttcagtttcccctttaatagtaatgagtttgaactgaattttatatactttggatgggaacattgacaaattttaggaagtactgtttcactcgcgtccgtgtgaagagatcaccaaacagacttcgtgtgagcaacaaggctgttcatttcacctgggtgcaggcgggctgagtccaaaaagagagtcaacgaagggagataggggtgggactgttttataggatttgggtaggtaaaggaaaattacagtcaaagggggttgttctctggccggtaggggcgggggacacaaggtgctcagtgggggagcttttgagccaggatgagccaggagaaggaatttcacaaggtaatgtcatcagttaaggcaggaacaggccatttaaatttcacttcttgtgtgattcttcagttacttcaggccatctggatgtatacctacaggtcacagggggatatgatggcttagcttgggctcagaggcctgacactgtttatgggtttttaataggggtatactgtttagttttacactgatctgaatgattgaggatctaatgtagacccatgccttggttggtaactatgctctagaattaattaaactcaaatctaattatattaatcttttagctaacagcactaatggaggagaggatttttgttgatgctggaatattacgggcaagcttcctgggaatcaacactgcctttgccagtggtcacctgccattatttttcaaaagcactcttactcatctctacttatgaatacaattaattagttgcagaatgttagatagagtggcagtccttggacaggctgagtgacagctgctagaagacagtaggaggcaataagtagacaattcatgtgtatatacttgagaacaagtggtaatttggtcgagctgaattgggtgccatgtttattacagccagtgattcaacctaaggctgagagccctagcaagggagcagtttcagaaaattgagtctgtaaataaagtctattttaaaagtcataatcatttgttaggttagaccccagaccttgattaaaagtatcaggagaacatatatccctgttttgaaatttcaggcagtgcaattaaaatattcctgtaaaaattcagacatattacttattaaagatactaatgaaggcagtgcaatcaaaaatcatacgtaatcaaatcagaagatttattaatggatttatagaatccatgtttgaaattgatgattttaagtagtcatgaaattcaatgtgcattaacaagtatctgtttatttcctaatatgtacctcacattgtggaagttttttgaggtatgggggtgggaacttctttgttatggtgcctctactaatgagcagtgtagccttggaaaaatcacttccttttaaaagaaactgtcatttaaaaatgtaatattctatgcaaatagaatagatataaaatatgtgcataataataaaataaacccctgcatacccactacccaacttgagaattataacattagcaatacaattctacctatgtactacttccctatctcctctccttgccttcccaccaccgtgtaaccattagccttatttttgtaataatcattctattttatagttctaacatgtatgtatgcaaacttagatatttagctttcttattttgagctttataaaaatggtttgtatattgttttttactcaatattgtattgctaagtttttttttttttttttttttgagacagagtcttactctgtctctcaggctggagtgcagtggggtgatcttggcttactgcaccctctgactcctgggttcaagcgattcgcctgcctcagcctcccaactagctgagactacgggcatatgccaccatgcttggctgatttttgtattttagtagagacggggtcttgccatggccaggctggtcttgaactcctggcctcaagtgatccgccctccctcggcctcccaaagtgctgagattattacaggcgtgatccaccgtgcctggcctgctaagattctttttaaggttttatgtaggcataattcattcattgtcactgctgaataatatttcaccttgggagtttactagagtttatccattctcctgtcgatgggcctttgggttgttcacaggattttttattttcctggcatgatcagtgctgctaagaacaatatgtatcttttggtgtgtgtgtatttattaaaggatatttctcttgtggggtgtgtgtgtgtgtaggatttgcatatacatagaaacacaaaactgtatgtataggaagtctcacatacgtaatcataggtcttggaatgtgcatctttacaaaaggaggtaaaattgttacccagagtagttgtaccaatgggcattctcactagcaatatatgagtttccattgatttatattttctcaacacttgctattgtttgagttctttctttttgccaatctattgtgtgtgaaattttatttcacgatgatattaatttgcatttctctgattactaatgaagttaaacatttttgcatatgtttatgggccatttatgtttctctccttatctacttgtttatttccttttactattttctattgggttatctttctcatactaactttaagagtccttttcatattcaaaacactaaagctttgtggttatctatgttgcagatatcttctctaagatactttgccttctgcttttactattttttttttggtaccttttgataaacaagttcttaattttaatgtagttaaatttttctgtctttttctttatggttagtgctttatgtatcttgtttaagcaatctttctctatgccaatgttgggaagctagtctcctgtttcttttttctaaaacttttaacattttgcaaattattttttgagcctcacttttcaggtctttagaatgcaggtatggaactagatgttccttaacatatgttctggtctcttactctttgacactgtgacctgaagtagatttcggatatgtgactgtgttttcagaatatgcagtgttcttttttattttttaaagagggttttttttttatcatgtatctgtaacgttaggcaaaattatttaaagtcaataaatttttattcaaggaattccatgttgtgatttcttccactgtccatcaaggtcactttagatctcctaaagagctggagtcaaaagatttatcttcaagttagccgtttttaatgaaactgatgcttattttaatccagttgtcctgtcagcccataattctttttttttttttgagacagagtctcactctgtcacccaggctggagtgcaatggcagaatctcggctcactgcaacctctgccccctgggttcaagcgattctccagcctcagcctcttgagtagctgggattgtaggcacctgccaccatgcccggctaattttttgtatgtttagtagagattggatttcaccatgttagccaggatggtcttgatctcctgacctcgtgatctgcccgcctcggcctcccaaagtgctgggattacaggcagcccataattcttttattttggcttctgtcatctccttttaatatggatatactgatgaagacttcaaaattcaccaagaatctttgggatctaatttcttcaatttagggtcatttttactgtaggtggtggatctgcctggttctcaatttgacaccctctcttaacatgagttcaaatcatattcattcctaagtgatcacactcaagaatagtacagatgtgtggaatatgccaatacctgaggtaaaaaagtagattatcaggtctttcatacgtttagtaactgtctttttcaaacttttagcaactgtcttatagttctttcccatagatctagcaatagtcctgtgagtaaagtaaaaccacagttactttatgaggtgtttctaaggacgtgcaggctacaggaatgcagtgttcttttagtaacctttcccactatgaagtttcatatttactcctacttctctttctctcatttccccagcgtcttccttcctgttttcttcagaaaagtaaccagctgaattctgtagtatcctagagtttctgtgttgaaacagcatttttgatgtaaaattttattgagatatttatggatacacatggaattgtaagaaaaaatgcagagagatcccacgtactctacccaatttctccccagtggtaacatcttgtaaaattgcactataatgccacaaccaagatactgatgttgatgccgtccaccaatgtttttcagattttccatattttgtattcacttgtgtgtgtgtgcatggggtgtgtgtgtgtgtgtgtatgtgtttagttctatgcagttttatcccatgcataagtttgtgtatccaccatcacatcacagaccagatacagaaggaaagaaatgttatttaaaaacagtgtgggccgggcgcaataactcactcatgtaatcccagcaatttgggaagccgaggcgggtggatcacctgaggtcaggagtttgagaccagcctggccaacatgatgaagcccgtctttactaaaaatacaaaaaaattagccaggcgtggtggcaggtgcctgtaatcccagccactcgggaggctgaggtaggagaattgcttgaacctgggaggtggaggttgcagtgagccaagatcgcgccactgcactccagcctgggcaataagagtgaaactctgtctcaaaacaaaacaaaacaaaataaaaaaaaccccaaaagcagtgtggtttaaagtctctgtcactgagtacccccagattgttccatgtgcccagtttggctggtgcccatacagttttagagagcaatctcaggttacataatttagaagcaaattgattaactgaaactttgacctgagaaagcagaggagctttagtcctgggtcctgggaggccagttggcatggtcctaaagtataataatcatttattttaaattatatccccatgtgagcctgcattggaaacatcctagtaaaagctacttagtccatcataccaataggagtcattaaaattctacctgcttattagcaactaaaagctagtagtggaaagagggagtgataatccttctaagaaagcaataaaaaatctgccaggttgtgcattggtttatagccccataaatagaaacttatgttattgtcaggaaggtagtcaaggacatttgaatactgtatttatggagagctacatatgctttaagtaactcatatccaccccaacatacttaaacatgcaacatctttagtgaagttcatttgtttactcctttattacctatttataaccagctaggcactatatgctaggcaatggggaccaagtggtaaataaaaacaaaagtggttcatgtcctgatggaccttataatccagtttagaatggaaaacccaacacattttttatttactcattttcataagtgttatgaataaaatgaataggatacagagatagcagaaataggatatgttttgatagggtaacatgaaagttctgtcagaggagatgacatttaagcagataactgaaggaatgaggactacttctgcaaaggggtttgggagtagttactggaaccagcttgcacaaagaccctgagttgggcaagagtcaggcacattggagaagcttaaaggaggctagtggggctgaagggcacactcagtggaaccgggggaagatggcagtgaatgggatataggaacttctggggagcatttggattttgtaatctaatttctggtagccatgaaggtgatctggagatggggagggcgatgataataaagttgtctatttaatccattcacacatatttattgagtatcctatcacatgccagacactgttctacttggtagggatggactgatgagcaaaacagacaggaatctctgacctttttgtctctacattctaatgtaggaagctgttgttagggtacagggtaaaataatgtaacaaagagctccaaaatacagtggccaaaaaattatagacgtttggttctctggcgtgtaacaacccagagaaggtaagcagtctcttttctttttcttttcttttttttttgagacagagtgtcgctctgtctcccaggccggagtgcagtggcgcaatctcggctcactgtaacctccgcctcctgggttcaagcgattctcctgccttagcctctcaagtagctgggactacaggcacccaccaccatgcccggctaattttttgtatttttagtagaaacggggtttcaccgtgttagccaggatggtctcgatctcctgacctcgtgatgtgccccgctcagcctcccaaagtgctgggattacaggtgtgagccaccgtgcccggccagcagcttcttttctatgaggccatccaccattccaggctgtgttggtcaattctgtctttcacagcatttgatttttaaagttccagccagcatgaaggaaagggagtccaggagaagcttctttaggaaggtgacagaaactttcacatattacttttgcgcacatgccattggagaaatcttagtcatgtggccctccctagccacaagggagacagggaaatgtagtttctggttggaaagtgaggtgttcaggaagaaaggaagaacagatttgggaggacaatccagtggacagggagacaggcagtaaacaacataattgtaatatctcctgtgatgagtgataaaggaaagataaagcagagaatgatgatagaaagtgtcaggggtgagggttgcagtttttcaaagggtgaagaaggcctcactgagaaggtgtcatttgaataaatccccaaatgaagttttgtgagcaagaaataccattttgggttgttatgaagcctataagaatgcatggttggttttaacatgcttgagtctaggaccttatcagaccccatcagaaagtagttagcgtggaaagacaccattgtgccacatattcacctactgcaagcaatacaaggccttaatgaatttttgttgttgttgttgttgtttgttttgtttttttttttgagacagagtctcactctgttgcccaggctggagtgcagtggtatgatctcggctcactgcaacctctgctccccgggttcaagtgattctcctgcctcagcctcctgagtagctgggattacaggtgcctgctacggcaccgggctaatttttgtatttttagtagagacggggttttaccatcttggccaggctggtcttgaactcctgacctcgtgatctacccgccttggcttcccaaagtgctgggattacggctgtgagccaccatgcccggccaatgaatgttaaattaatgagttatgctaggacctggactgaggtatctgattttttcttgactttttttttttcgttttttttggagacagtgtcttgccctgtcaccaaggctggagtacaatggtgcaaccacagcccactgcaacctcaacctcccgggctcaagcgattctcccacctcagcctcccaagtagctaggactacaggtatatgccatgaccccagctaatttttttttttttgtagagatggggtctcactctacaggttggtcttgaactcctgggctcaagctacatatgctttaagtaactcatgtccacctgcctcagcctcccaaagtgctgagattataggcatgagccactatgcccagccttggctttttcttagatggaaagcttagctcccaaagaagggagggactaagattcttctgccacacacagttaagagtgttgcacatacttggactgtagaggtgtttgttgtgggggcggtgggaggggagatagatttttgctaagggtagaaattatttatggtctgagtttgctgtagagctctagttaacttcaattagccattgtcagtgcggtttaaggatgtggtgacatgaaagagtggaagtattttcatttttgcccttgatcttccattcatttttgcccttgatcttccaaatcttgcttagtagcctttccaattacagcaggcaatattttccaaccttttactattttctttaattatatttgattgctgctttaaacatttttacataaaatacgtaagtactttaaaaaaaaaacttttcctgtgtcacttttttaaggataactcatttgtttaatgagccaaaagaaaataattttctgcctattttttctctaatccccttcctacttacaacatccctaggttggagtacatagattgtctttgggatttcttatttttgtggtaaattatgtttcactagggaacttacagttttagaagggagataagaaacattgttatataatgaaaatacaagacagaaagtgacaaatgctatgagaaggtaaaagtaagatgctcctatagttcagagactatggcatgagatgaataatcctgtcagtctgcttccacaaatgtgaaaggagacattaaagctacctacgagcttaatatataatgctctcaaaaggaattttccattcttggaaaagggaaacatttgatctgtcatcctactgtttatttttgtaagccccgtcttttcccaggcacagataaaatccattgttttcctctcacactatgccatagggaaaaattcaattcagattggaaaaagcactgctaatcacttcacaacattttgtagagttagccttgaatctttcttcctttccctcactccgtcttacccagtccatcacccaattccacagattgtggtcccctgaattgtttttttggatccactcttgctactcttattccatctctgcaaagcagctaggctgactctttttgaaacatacattaagttagtttctagctaagaatccctagtagctccgttcatacttagagcacgattcagactccttactctacctgctaggctctgcatgcctgcctgcaacagtatctctggccttctctgagggatctaccctcctactgtattctgtttctactgtgtgcggtcttcccactatatggaatgctctctccccgaggaccccatttctgctcctccttcagaactaagttcaagtgtcttttccttaaagaagccttccctgacccaggctaatgtcagaccacccaatcttacagggcctcatagtaccttgtacttctcttatgtacctcttcctgcaattgtaattaatgaattacgagactagttattagcccccctctacctgtagaacaacatctaaaaaataaaaaagcatattattttttcgagatggagtttcgctcttgtcgcccagtctggagtgcagtggtgtgatctcggctcactgcaacctctgcttgctgggttcaagctattctcctgcctcaacctcccgagtagctggattacaggtgcccaccaccacgccaagctaattttttgtatttttggtagagatggggtttcaccatgttggccaggctgatctcgaactcccgacctcaggtgatccacccacctcggcctcccaaagtgttgggattacaggcgtgagccaccgtgcccggccaaaagcatgcgtgttttagtttactcagtactccacccagtgccagtgtccagtctagttctgggcactggaataaatgctcaaaaaatatttgttgcaaaagaaaaagcagaaaattcacaaattatgtaaatttagttttgaattttgtttaggtccttacatttgatcgtaggttttctaattttgttagagtgtttacaaaagacaagacagtgtatcacatcacctgggagctgttagaaatgcaattctcaggcccctgattcagacgtactaccccagaaactctgggtagggcctggcaatctgtattctaacaaaccctccaggtgatggtgaggcataataaaatttgaaaaccggtgttctataaaaatattgagtgaaggttgtctttgccctagttcaggctgctataacagaataccacagactgggtagcttaaacaacccagaaatttacttttcaaagttctagagcctggtaagtccaagatgaaggctctggcagataggatgtctggtgagggcactcttcccggtttgcagacgctgtcttctggttgaaatcagagagagggatagcaaactctttggccttaaaaaaattttttttatagttaatttttttttttttaatgcttaccggtttattataaagggtactacagaggatacagttgaagagacacatagggtgagatatgggagaagaagctcagagcttccaggcccttcctggggttgccaccctccaggaacctccacgtgtcagctatctggaagcttactgaaccctgaccccttgggtttttatggaagcttcaagacatcagcattccttcccccagggtatagggtgggacccttgcatggaaggctcttaagacctacaataagaaaggagggcaggaaaaggtcagaggcctgccccctgagtcctaacacacccaacattataacaaaatgctgtaacaagggctatggaagttatgagccaggaaccgtggatgaaaaccagtatataccataataccacaggccaccccctggtttttgactatggatttttcacataaaagtatatactatgcacaatcattaataattacttcagcccatcatagtatatgaatgtcttccaagatgaggccactcctgtttgtgggtttcttctcaatcttgtcagcttccaaaagcaggagtggccttggtaaatatatatagctttaccctttcaggcatctgggattattgagcttatagacaatgttatctcttgctctgagactcttgagttggtaacataatatttaattttcctcaatatcccatttattcatttctttaatttcagctagtatttctccttctctccgttggtacactaactttttcaacattggaagagacattagaattgtcactgtgctggtctagatagcaggcagcagtacaagtctggcaagtacctcctcctcagtctactcagacagggtaaggttacaaaggtgtagaactagtgagctatttttaccaccaggcaatatagctgcaatcacagttagccccaattttgctagatggattgaaggcacaatccatcatgaccttaggaattttgacgtaaggtttaaaaacatagtttgttttttgcttagaaatcatccctgctgttctaacacttgtacttgcagccctggtcctagggccattgcatcaggtaggggagaaaaaattaatatttttttcctgaggtgatttgaggaagaaagaacaaactatagtcgttatgttagtgtagtcctcccttggcaggaactacatagtcatatcagtgtgaaccccagatatctgagataggtccagttaatttaggaagtttattttgccaaagttaaggatggtctgtgacagcctcaggaggtcctgatgatatgtgtgcaaggtggtcggggtacagcttggttttacacattttagggagacctgagacatcaatcaatatgtacctcggtttagttgggaaaggcgggacaacttgaagctgggaggggcctttcaggtcataggtagataagagacaaaagattgcattcttttgagtttctgattatcctttccaaaggaagtaatcagatacacattcatctcagtgagcagagggatgactttgaatagaatgggaggcaggtttgccctaagcagtccccagtttgacttttccctttagcttagtgattttggggttccaagatttaatttctttcatactggcatcttccccaccccctcttccccagataaaccagaaaaacagaggaaaaaaaaatctatcagggacactctagtcccattcatgttgaggtgtgagcacacactcatgaaggtgtgtaagccagcccttcatgcttttatctccccgttttagacaaccaaggtttcagttgcccattctacttctctgtcaaactgttacactaaggatatcttgctactcattgttggactttgtgggctgtacagtgtgttccttggtctgaaaaaatgatggccagccatccaaatctatacaatatcttctatatttttttatggtactctgagcattttcatcttccattagataagcaaagcccactccagagtcagtgtttattcctgtcaggtcccatttttagcctccccacggggctaccagcattagtctcagttgccagctatgttcagggccttcccaccagagaatctgccccgcagccatcagcaatctctgtctcttttgctgagaaacagaacagttctttctggcattttgtgcctgagagggtgcaaaaggaacatgtctagattcagcccatcactgtagtgctacaatacccccatatccactcatttcatgggcccaggtggccacttcaagggagcacacagggatatctacttgtcgattccagtcaacttccaaacctggaagggagttctgatgggcactgacttactctcctttaatgccccctcacgtctccacagggccatgcttcatttgggcattcttttgatagtccaggtgtccatggccctcttgtctgagtgtatggctaggccattggtcactgcccatgagtcagtaaaaacccaaacccaggggtttgcaccattgttcaattctttcatcactgttagaaaaactgcatgtaattcagcccactgagtggatctgtttttaccttctttgatctaagtagcagccttccaaacaggatggtgtccattcactttggaactgtctggcttcttttaagggcactaactcctccaggcttcactgccatgatctaatcacctctcaaaggccctaccttctaataccatattgaaggttaggatttcaatattaagaacttggggttggagggggaacccaaacattcataacacttggtaagtaaaatataaagtccagtttacacctccttacctatttacaaaattaagtgcattgtttcttaccaacactgggtaatgaacttctttttgccccctccccattttatcagttgatgtcttcagatgttacccggaatgtaaacaagctctgcttgaccaactgaactgtaaacaagtctactcaaacctgaactttaaaaaataagggttctccaacttctgcctcctgaattcctgacttttatatactgccatataagtccaggattctatagtaactgttggagggttttaatttttttcaaaaatgtttattgtaaaaggacaaaacttttttttccctctaaagcttagatggtagtttctgattttgtatctaaagctttgtgaagcattagcaattttttttttttttttttttttttgagacggagtctcgctctgttgccaggctggagtgcagtggcaagatcatggctcactgtaacctccacctcccgggatcaggtgattctcctgcctcagcctcccaagtagctgggactacaggcgcatgccaccacaccccgctaatttttgtattttttgtagagacggggtttcatcatgttggccaggatggtctcgatctctcgacttcgtgatccacctgccttggcctcccaaagtgctgggattacaggcatgagccaccgcgcccggccagcattagcaatttttgaatgtgcatatccttggctgttcaggctccaggattgtgctacacaatcaagttgttattgctgatggattgaccacattgttaaaataggtcgctcatccccgattttgccgctggctcttaattcacttcatgtttgactcaaagacactattttgacaaaactacttccatctgatgactattagatgagccataggaaattaattgcaggtttctttcttgtacaacaggtgtccagggctcattgattctctttctgatatgtggttagaagcagagtttggggattctttcttgagataaccaagaaatctttttaaatgtttaaaaaaaatttttattttagaatcattttaaatttacagaaaagttataaagatcgtgtagtttccatatatcctgcacccattttccctattgttaacatcttgcagtagtaatgggtaatttgtcacgattcatgaatcaacattgatacattattttaaactaaagtttatactttatttagattttctcggtttttctttaatgtcattttcctgttctggggtcccttccaaaatgccacattacatttttttttttttttgagacgcagtcttgctctgtcacccaggctggagtgcagtgatgcgatctcagctcactgcaacctctgcctctcaggtgcaagcaattctcctgcctcagcctcccgagtagctgggggttcccgccaccacgcctggctaatttttttgtatttttagtagagatggggtttcaccatgttggctaggctggttttgaactcctgatctcaagtgatccccctgcctcggcctcccaaagtgctgggattataagcttgagccattgcatccggccccacattacatttagtcatcatgtctcctcaggctcttcttggctatgacagtttctcagactttccttcattttggtgatgttgacaattttgagggatactggtcaggtattttgtagaatgtccctcaactgggatttgtctgatgttttcctcgtgattagactggtgttactgagttttggaagacgagagatgaagtgccatttcatatcatatcaaaggtaaatgttaacagcatgacttaccactgttggtgttgctataactcagctatctaaagtagtgattgccaggttcctccactgttaagttactgtttttcctctttccatactgtactctatggaaacaagtcactaagagtagcagaagagattgttatttaagtaggagattctaaagaatatcatttcttgctgagtgagaccttctccattgtttttcagtatttccttttaagttttactttattaggagacaggtgtatgcagttgacatgtttcaaatattgatttaaattgtgaagggatttgacattaaaatgaatattttagtgaatattctggagcacttagttggaacctaacgtatttgtgtaaatgctcctgtgtccacctgttgcccacatctactcatccccacgtctactcatcccccagcctccaagccttctctgtttgcctgtagctcctggaatctgattgcctcatagctaaaacctttatgaaaacatttgggtagagtagcccaggatttctttgcttggtaagaactcacttgctaaaatggtttttattaaaatatgtttgtgcttcactactgtgcttcttttgctagaatagatgcagccctaaagatttgcttgtcttcctaattcctttcttaatacctcatagtagtgactgagctattgatctgaagggataataacagccctacacgtgctttttgcaggttctgatatcttaagaactaaccgagagctttgaaaaagaacattgccttagtgacataaattcaagcctgcttcaaaccaaataatatacagcatgtgtcataaagaaggttcattcctagaaatcatcatattcaaaaggagcaaaggatgaggaagaaggaattacagcaagtgatagtacttgctcaaagactgttaaccagggtcagtgccatgggaacattgtctccagcagccccactcactctctacccaccccactcctaattcatatccctggctgctgctgctttttttttttttttgacacagggttttgctctgttgcccaggctggagtgcagtggcatgatcatagctcactgcagccttgacttccccgttcaagagatcctcccacctcagcctcctgagtagctgggactacagtcacgtgccaccacgcctggctaaatgtccctggcttctaacatgcacttaaagcacttctcagaaagactgtcccagtagaaaaggtgcacagaaagtaaacaattcactttttcttttttcttttttttttttttgagacagagtcttactctgttgcccaggctggaatgcagtggcgccatctcagctcactgcaacctcctcctcccaggttcaagtaattctcatgcctcagcttcctgagtagctgggattataggtgtgtgccaccatacccagctaatttttgtaatttgagtagagacagggttttgtcatgttttgaactcctggcctcaagctgtccgcccgcctcggcttcccaaagtgctgggattacaggtgtgagcctctgcgctcggcccaattcacttttcactgaagttgacctttagtatattgttagtagttttggattctagtttgagttatcactagaaaaaatagtgaacaatattttattattttttattgatacataatagatgtacatattttgggatacctgtatatgccccatacccagtttcccttattattttgagacagggtctcactctctctcaggctggagtgcagtggcccaatctcggcttactgctaccttggcctcccgtttcaagtagttctcccacctcagcctcccgagtagctgggaccacaggcatgcaccaccatgcccagctaatttttgtattttaggagagacgtgatgtcaccattttgcccaggctggtcttgaactcctgagctcaagccatctgcccacctcggccttccaaagtgctgggatttcaggcgtgagccaccacacctggttcagtttcccttattattaacatcttacattagaatggtacatttgccataattaataagccaatattaatatattattattattgggaggctgactgggccttgaggtcaggagttcgagaatagcctggccaacatggtgaaaccccgtctctactaaaattacaaaaaaattagccgggtgtggtggcatgcttgggactacccaggaggctgagacttgaaaatcgctgaacccaagaggctggggttgcagtgagccgagattgtgccactgcactccagcctgggcagagagagagagagagagagagagagagagagagactctttctcaagaaagggaaaaaaagtgtgtgtgtgtgtgtgtgtgtgtgtgtgtgtgtgtgtgtgtgtgtgtataaaattaactgaagttcatacttcattcagatttccttagtatttctcaaatgtccttttgctttttcaggatcccatctaggtcaccacatcatatttagtcatcatatttatttggactcttcttggctgtgacagtttctcagactttccttgtttttggtgactgacagtttagaggaatactggtcaggtgttttgtagaatgtccttcaattgggatttgtctgatgtttttctcatgattagatgtgagttgtggattttggggaggaagaccagggaggtgaagggccattctcatcatatatccacggtacatagtgtcaacaggcttatcattgatgatgttaacttggtcacctttctgaagtagtgtttcttaggtttacacactgtacagttatctttttaaaaatgatttgtattgatttttccgtctctgattctggagaggagtatggttcattttatttattcattcagcagaatgaaatatacagtagattattgttaactatagtcactctactgatctatccaacactaggtcttatttcttctaagtgtatgtttgtacccattaatcaacctataatcccagcactttgggaagctgaggcgggcggacagcttgaggccaggagttcaaacatggcaaaatcttgtctctactaaatgtttccagcaaaaaaaagagataagtgtttaaggtgacctttagtatattattagtagttttggattctagtttgatttatcactagaaaaaatacatctcactgtgtttagatgcgtctactataaaagccaaatagacaaaaattaactgggtatggtggtgcatgcctataataaggtgatggatatcccaattactctgatttgatcattacacatgaatgtatgaaaatatctcactatgtttagacacatctactataaaaggcaaatagacaaaaataagctattctaggccaggcgcaatggctcacacctgtaatcccagcactttgggaggctggggcaggtgcatcacttgaggtcaggagttcaagaccagcctggccaacatggcaaaaccctgtctctacaaaaaatacaaaattagctgggtgtggtggtgcgcacctgtaatcccagctactcaggaggctaagacaggagaatcgcttgaacccaaaaggtggagactacagtgactgagatcgtgccactgcactccagactgagtgacagagcaagactctgtctcaaaaaaataaaaaaaaaacttattctaaaagtagggattttttgctggacaaatttattaatctaagttctgcctaatgaggtctaggggaactccctgaatttgagcgaaatgccaaaaaagtaagctaaaggatatttaggtttacattattttcctcactgtcactttccagtatctcttatatccgtttaccacgtggaagaatctagtactcacttttaaaattttttgagatggagttttgccctttttgtccaggctggagtacaatggcatgatctcggctcactgcaacctctgcctcctgggttcaagtgattatcctgccttagcctcctgagtagctgggattacaggtgtgctccaccatacccagctaattttgtatttttagtagagacggggtcttgctatgttggccaggctggtctcgaagaatgtgattttatttatgatttaccagttattagactttctcacctcttcagtaattttagttttttattatttttattgatacattaatagatgtacatattttgggatacctgtaatattttgatacattcataaaatgtgtaatgatcaaatcagtaattgggatatccatcacgttaaacatttatctctttttttttgctggaaacatttggaatcttcttttctaggtattttgaaatatacagtagattattgttaactatagtcactctactgatgtatcaaacactaggtcttattcttctaagtgtatatttgtacccattaatcaacctctcttcatcttcccttcccccaaactcttcctctgataactaccagtctactctctatcttcatgagatccatttttgtagctctcacatatgaatgagaacatgtggtatttgtcttcttcacttatttcgtattcgtaagtagtgaaaagtgtgtccttaagtgagaccttttctgtcttcccagctttaatataaatacaaaagattgtgtgatactagggataaagcaacctccttattttcattccttcaaatgctagtcaaggtaacagatgaagatcagaaagtactaggaaaagaagtcaccatcacatcttgtgttgaaatttgttagggagtttcagtatcaaggaatgagtatgtcatgcagcagatgagcctctaggatgaatttgattaattcttcccagcagcaaaatctcataatcaaataatgttgcttgaggccttcttttgctttggagttagagaatctaaattgtgtaagctctagtggatttccattctgtcgtatcaagtatcgatggtctgtgtgaatggaaagagcagattttctgttgggctatatatatgagctcattggaaagagttaagaattattaaaaaaaaaaagaattataagtaaatacattttactggatttaacttcctaatgacaggcatctctaccagatttgatgatactgcaaacatggaaggaacataggcatctgggtttctttgctggctatgccactagtttgttgtgcaatttttttttttttttgtagtttgttatgtaactttctcaatggtcctcagattttcatctgtacagtgagagtaaaaaggccagagcattgcttaaaccccttaagaccatctaaatctgtggttcagaatgggaaataagagtagcaatactgactgtcttcccagttacctgttatgctcatgataaggtacattagataaaaatgtaagaggaatctgattttcccacaaaacgtttcatatatagttggggacatgatcttaacctggtgtcaaattcttttttctagatatgactacaaatatgagaatgaataaattatatgaaatgtgaacatgaatagatttctaggtaatacctatgggccatagagctttttaagatatgcatttttgaccaggcctggtggcttatgcctgtaatcccagcactttgggaggctgaggcaggcggattacttgaggtcaggagttcgagaccagcctggccaacatggtgaaaccccatctctagtaaaaaacaaacaaccaaacaaaaaaacccaaaaattagccaggcttggtggcacgcttctgtagtcccagctgctcgagaggctgaggcacgaaaatcgcttgagcctgggaggcagaggttgcagtgagccgagattgccccacttgcactccagcctgggcgacaaacattcctaaaagtagttgtgagtggagtaaatgtacagagacaagatctctgtatactggattccatattcctcttctcctttctttctgtgtgacaggctctcattctctttcactggtatttttgagcacctcttttgaacttagaggcgtgcctcatactctctgatgttggggggactgtgtgagcctgttggcttctctgtctacgtggctttccaatggacagagctggggcaggtcagccctgaatgaggctttgagtcttagcctgtcttgagttagagagaattttgggaacctcagactgctagctcagcagttcagcatgtttgctagtatcattctgactttgtgtggtcatgtttttgtaagattgctgttgtctggctcgttgtgattaagactagcccttgtatttctgggccagaaactggtccttactctgtttatcccctgtgaagtccttttatgggtacaatggttggcaccccaattcatccaaaggtaggaacatgttttctttttagctaagcttctggggaacttaagctctgcctagacccatacctgtggttgggtctttgctgcccaatcctgatgttatagatgctcacccactaattgcctttttaccagatttccctgatgttatattctgtctgcttttaccttgctgagtatcctcatgctcactgctcacctgcctggacctttggttgttgctgcactgtcttttctagtaatgtgctcttgtcacttggatttccttctaggccttgcttctgggtccacctccaagcacctgacattctgtactttttgatctgccatgctgcctgccttcagtagcttaattatgaaaatcagtagttttctttctctggaacctttattttaaaaatctattactaggccgggtgcagtagctcgcgcccgtaatcccagcactttgggaggccgacacaggcagatcacatgaggtcaggaattggagaccagcctggccaataaggtgaaatcccatctctactaaaaataggaaaattagccaagcgtggtggtgtgcacctgtaatctcagagacttgagaggctgaggcatgagaattgcttgaacctgggaggtggaggttgcagtgtgttgagactacaccactgcactccagcctgggcaacagagtgagaccctgtcttaaaaaaaattaattaggggcaagggagaactagaatcatgaaatctttgtattgaaaaagactctcagaagcttatacttcaactttccatcagatggatagcttggtaactcccaagataacccatcaatcgcattttgcagtacctctctattggtttcttgtgccaaaaccatcaatgcattcatttatttattcactcattccttagtgtctgcacagttactaaacatctacctttagctaggcaatggggagatgagtatgtgtgcatgcatgtgtgtgtgagtgagagagagcattccagtttctaggaagctgctagtccagttggggtagagaataaacaatcatgatggctagctagagatatacattgggcgggagaatgagtcattttctctgcatgactgaagggtggttcatggagggctttctgccattccagttaacaccaactttctctttttaatttaacttttattttaagttcggggtacatgtgtaggtttgttatatagttaaacttatgggggcttgctgtacagattattttgtcactcaggtattaaactagtacccattagttaacaccaactttctagtccaccaccagcttttcagctaaaatacaggaaactcctcatcttccttcttttttttttttttttttttttggccaatctctgacttgcttttggaatcatctttctttatgcaaatcttgatttgttcttcccctgttcataggctgcccattgtttaccccacaccccacaaggatatctaacttcttggcataactcatgaagccttcgacctttctgattcatgcctacttctccagttttattacatgctattttctatcaggttcttagtaccctagaacttaatgaagtttgctggctacactgtgcttacttgtacttctgttgcatgtgctgttcccactgcctggagtggttgccatttttgctttcctggtgaactctggggcactgagaacttgatagaaaatggtatatggggaaaaatcacaagtctgattttcctcttctgttatggcgtactccagcctgttggatgctgttgcactttatacaccccccactcctgcccaccacaagattgtaaactacttcagtccaggttatctttatgtcttcagtttaacacagagcctggcccagagtgggcagtccataaataattgttggatgaatagatgaaggaatgagtgaataaatacaagtttctatagtctgtttttcagtttacttcttccttggggctctgataatggtacttaaatggatcctatcactgttttgtttcatttagagatggggtctgacactgtcacccaggctgaagtacagtggcattttcatagctcactgaagctttgaacttttaggctcaagcgatccttccacctcagcctcccaagtagctggaaccacaggcatgttccaccatgcctggctttttaaaaaaattttttgtagagatgaggtcttgttttgttacctaggctggtctcaaactcctggcttcaaggaatcctcctgcctcggcctcccaaagtgttgggattacaggtgtgaaccaccacacaaaaccacactgttttgaccatagctccttgcaaagccagaaccatgcacactggcttatccactactggataagctacctgcctgccaaaacagagagaaaagccctttaggggttttagaaaactcttgatcttctcccaccctgttgtctctgctgccaagataagcttctactatgtcttttcagaactctgatcaagaggtagaaattgcatagaataaaaatacttcaccccttctcttctaaatcagagtggttgtgaagtgaggagaattagtacttgaataaaattcctgtctccttaggcagttctttgaatgagtcatctacaaactcaagcaatttgtaaggacaattatggccatttattctgttgtcagcctgttttgaataaataccaaatggagtattttggttcttaattatgcctttctcaccttcttaccagagcccgtttttacacaattatatcaattaacagtgagagacacatacacaactttcatgaacttaatctgccctgcatatcttcctgtgctttaatcatgatcttaaatttataatcagaaatcagccttttcagttcaaatcagttgtagatctctgcctaaaatagttggctctttcgaggttgttacttttgtaacacaacttttttcttgagaattattgaggtataatttacatacagtaaaatttgccctttttaggtatgtaaaaatcgatgaattttgacaaaattatataaattgtaatcaccactgaaatcaaaataatcaaattttctgtcacctaaaaagttccctcatgctcctttgtagtcagtcccctccctaaactgccaacccctggcaaccgctaatctgatttctgtcccttacagtttcgtcatttctagaattccatataaatgggatcaaaatgtatagcctttgagtctggcttgttttacttggcataatgcttttgggagtcatctatgtccttgcatttatccagtttgctgcctttcattgctgagtagaattccattaaagagataacactataatttgtgtatccattcaccagtagctgatggacatttggactgttttcactttttggtggttatgaataaaggtgctgtaaatatttgtgttcaggccaggcatggtggctcacacctgtaatcctagcactttgggaggccaaggtgagcgagttacttgaggtcaggaattcgagaccagcctggccaaaatggtgaaaccccatctctactaaaaatataaaaattatctgtgtgtggcggtgtgtgcctatagtcccagctactcggaggcggaggcatgagaattgcttgaacccgagaggcggaggttgcagtgtgctgagattgtgccactgcactccagcctgggcaacagagtaagaccctgtctccaaaaaaaaaaaaactgtgttcaggtttctgtgtagatgtatatcctgttttcagtaaatatataaaagcatcatagactgaaatgtactgggtacattttcatactgggtagtatgaaaactatgtatttaactttatatcttaagctgcccaactatttttcaaagtgactataccatttttgtttcctaacagcaacatataaggttgcatttgctccatatcctcaccaatattgttattgtctgtcctttaaaactttagccattctggtaggtgaatagtaatatctcactgtaattttattctgcatttttcctaatgactaatgattttgaacaagtgtcttaacatttttttgatttggcagggttttgaaaaattatacagctttgggctgggcgcagtggctcacacctgtaatctcagcactttggggccaaggtgggcagattacttgaggtcaggagttcgagagcagcctggccaacatggtgaaaccccgtctctacaaaaatacaaaaattagctgggcgttgtggcgggcgcctgtaatcccagctactcgggaggctgaggcaggagaatcacctgaacccgggaggcagaggttgcaatgagctgagatcgcactgttgcactccagcctgggtgacagagtgagactgtatcaaaaaaaaaaaaaaattatacagctttacagctttgagtgttctttatatattctggctactggtcctttatcagatatgtgttttgcaaatgtttttcccagtctatggcttgtctttttactttttaaatagtgtgtttcaaagagcagtagttttgtgtgtgtgttttttttttttttttgagacggagtcttgctctatcgcccaggctggagtgcagtggtgcgatctcggctcactgaaacctccgcctcctgggttcaagcaattctcctacctcagccttctgagtagctgggactataggtgcatgctaccatgcctagctaattttttgtattttagtagagatggggttttaccttgttgcccaggctggttgcaaactcctgagctcaggcaaatccgcccaccttggcctcccaaagtgctgggattacaggtgtgagccaccacccccagcccaagagcagtagttttaagttttgattgaagttccatttttcagtcttgtgttgtctgtttttttcagacagggccttgttctgtcacccaggctggagagcactggttcaatcatggctcactgctggcctcctgaactcaagcaatcctcctacctcagcctcccgagtagctggtactataggtgtgcaccaccatgcccagctaatttttgtggttttttttgtagaaacagggttttattatgttgccctggctggtctcaaactcctgaagagatcctcccaccttggcctcccagagggctgagattacaaacgtgagccactgtgcctggcctcaatattttcttttatggttaatggtttttctgtcctatctaagaaacagttgcccaactcaggatcatgaatatttgcttctattttttctagaaattttatagctttagggtttacatttcagtctatgatgaatttccggttgacttttatgtatagtgcaagatacaggttgagattcattttttgaatatagatatatctaattgttccagcatcatttgttgataagacgaaaaaaactatactttgtctattgaattagcttggcatccttgtcaaaaattaattgaccatatatgtgtggatcagtttctggaatttttattttgtttcattgatctatgttacccttttgcctacgctgtctagaatattatagctttattgtaagtcttgaaatcaattggtatgagtactccaagtttctttttttttttacaaaattgtttaggttatcctaaattattttttccatataattttggagttaccttataaatttttgaaaaagaaacgggattttatttgctgtgaattaaaatctatagataatttggaggagaattgcaatactgatgatattgagtcttctgatccatgaacacagtgtatctctgcaaggaagtctttgatttctctcatcagtgtttttgatacttttcaacgtacaaatcttataatactttgttagattgatccctcagtatcacatgtttcttggtgctgtagtaactggtgctttttttttttttttttttgagatggagtcttgctctgttgccaggctggaaaatctcagctcactgcaacctccacttcccgggttcaagcaatcaagcaattcttctgcctcagcctcccgagtaactgggactacaggtgtgctccaccacgcccagcgaatttttgtatttttagtatagacggggtttcaccatgttggcgaggatggcctcaatctcttgacctcgtgatctgcccaccttggactcccaaagtgctaggattacaggcataagccaccgcgcctggccacaactggtgcttttaaaaatttcattttcctgttcttcactattgtgtataaaaatacagttgattttttttatagcaaggcaaggaaaaaaaacaatttctatatattgatcttatgttcttaaactttgccagtcactaattatatctagtagtctcttatagattcttttatattttctggatagataattacattttctgtgaataaaggcagtattatttttcctctcccatctataagtatctgtattttttttctgtaccttattgcattagctaggagttctatcttatatgatgttgagtaggagtgttaagagtggattccctgccttcttcctgatcttagggggaaatcattttgtgttttattattaagtatgagttagctgtaagtttttcatagatgctctttatcttttttttttcttcatagatgctctttaccaggttgaggaagtttcttttgatttctagttagctgagttgttgttgctgttgttttttaagtaatgaagggctgctgaatgaatcttgcactttttctgtacctatagaattagtcatacagatttttccttgtttttgactgctgacactgtgaatggcattgtgtttgacgtatgaatgccgaactattcttgcattactagtctaaattccacatggcaataatagcttattctcttgtattttatggataaaaatcatggataaaagaaatgaagtaggtagcaattccttaaccatatgtgtgttttataagtcatagaaatttttccatcctaagggaagtgctaactcccttgcttagcatacaatacaggtagcatgtttttggttcctcttcgtttggtcttttaggctatcaaaagtgagtggggggaaatgtaacaaaaatagtatgtactaggcagtgtgtatgtttatcttatttaatctcacttgatggaaagtgaggtccatcaaacaatttgtaccaccaagtcttggagctagtaaatggcagggtggtgggggggcggtcagaatttaaatgcaggtgttttggataaaaccgttattagctcactgtatggtatcgcctctctttggaagtgagtgggtatgtgtgtgcatgtgtttgtgtttgtgtgagagagacagaggaagggagggaaggacaggaattgggagagtgaggtagaaattgagatttggaaggagagaaaagccctcccacctttcattgccatctaaaatctgggcttttagatatcgtgatttgtatctcagctttgccatttacttgatttgtggcacatttgtctctctgagcctcatgttttaaaaatttgaaatgtagaacatttacattgagttttgaggaatacagataatatatgtaaaatgtctcacatagaatgtgctcaatttagtggtgtccattactatcatcattattgatttcctaccattaaatgtattttgtaaatgaaaataatctggttttagaagatggcaaaggagacttagaatgatttctatagttgtttgtttagttcttttgacaaaattgcctaaagttcttttataaaaatggaattcattttgtctacttttcactccttctcaagtcaaaataacacaaggtatttactaaatcagtttgcaaatttggaaaattttaaaaagtactgctgagctgggtgcagtgactcacgcttgtaatcccagcactttgagaggcccaggagggaggattgcctgaggccaggagttcaagaccagcctgggcaacatagcaagacctcatcaaaataaaaaataaagtattcctgaatgctctggacttgcctactggtttggaagtggttatctcagtgtggaggattggagatgccgtttttattttacatggacaacagaccattgctagctaactttagtcccttagcccatgtagatctgacagtttatgacgtgagactgtcttctctaagtgacacaaaccatttcaggttgtttcagtaaggttattttgggtcttacaagcagggcccaagagcttctgtgtgtttcattagtcaagtcagggagatgagaatgagtctgagaaagggcatcagactatcagtgccttggactttgggagggctgttggctccaactctaccaatcaatagccttctgggaattggttcatatgattatttgatttcatagaagtactcttccagccaaaagtgctgcttgacacatgaaaattgtatcttgacaatttttggataataccacaccatcccttgatattgttgaaaatcagaattggtaatcagtatgctttccttctagccatgaagtctttaagtaaatatgttaaacttagagttttattgtagactttgtggttaattatgacctttcttagcaagctgatgtcacaatgtaataagtaagttatgtttctcatatttattcagaagtccaggatgtctttgtgttagggtgatatttaggttttgatatcttcgatttgtctattttccccaattgtatattcagtctgtaaaatttattttactcttttccaattacagtggccacatcttcttatttaattttcaccttactttgtacatcattttagggtaggtcttattgccaccttatgatgaaaaaaataaggctacattttcccaaagatcatcattggacagtgagtccatattcagaagccaattctgatttttgtttatgttctttggattagacctctgggccttgagcttgatctggctctctaaatttcattgatttggttaacattcaaaaactaaatatctaatgactacctttgtcccacagttaggatcaacaaatgtgattagatgcctgtcttcaaaggagttcatgaaataaccagtcggcaagaggcaaagtttgggaatagtttcttctacccttcatacacataaccatctctttctagattgatggagagggttccagtgtccaagcaggaatgaccaggcttcatgaaacttttgagtggctttaactaaaatgttgggccatgaggtgaggcccaaccttgtagatttagtggggcctcttgaggagctacttcgtgttaaacactattctaagattaaagcaaaacaagcaaaaaatatgatttcatccttcaggacctcacaagctagcagacaagatggaagcatacatagaggtgcttccaatttctgctttgccctgtccacccttcgttctgctagcagaacagttttttgaaaaacatgccctttccttgcttaaaactttctggtggctccctgtttctcataggaccaagttgaagtttcttatcaggacatacaaggcctccactgatttggcccagcttcttctacacttccacagcttgcttcaggcacataccactccttggggtgcttagaacccatcatgatttttcatacctctgggtatttatttatgctgagctctctgtatagaatgctgtattaatctgggtcctctgaaaaacagacacacaggattaaattggcaagggtttattaggggaaaatgcatgtggaacagacaatggtgagggggctgagaaggctgggagtgccattagtccttcatgcaagtctgagccctagtgaaggggggataggggagagctggttaggcagaaggtttccagacggcagtgcagtctaaagaagattcagaaaagctattggggagtgcaaagtcagctgttagtggagtcctgcaacttccagcaacagtctgctttggtatccctgctgtactcagtgattggttgggagcacccctttggaggtgtgacttagtacagacactaggatgagtttctgaggcagatggggtccttaatcagttgtgctccttgtagttggagacccttgagttgcctcttggcctcttcttggctaccataaattccttttctctttcgttaaattcctcctgcttgtccttaaagggccagctgtaaatgttttttcttccaaaaaacttttcattgaaggaaaatctcagaatgtccatcgtgatcccacgtcctgccatgatcataccataatctttgcttggcaaatttttaatacatttatttgatttgtacccctaccacctattacaggaccaaaaatctgttaggtactcaggaagtgttcgtttgaatgaatgcattggtagggcttggacaggcagatctggggagaaggtagttgaggcagagggaactgcttaagcaaagccatagagggagaagaataaaggatttacactgtagttaataaatgtcttttttccccaaataagtatatcttcccccaaagctgtcattttagagaaagcctattatgatgcaaaacagtgggggaaaggagtgtcttcctggcagttgaaaatgattcatatttgagaactttgttgaacaatgttttgagtatttcctgagagacttctttcttgagaggaaacagttgatggaaatggaattttactgctgccaggaaaagtgcgataaagataaaatctcatgcaacaactactaccagaatagaaatttccatagagcaaagagatttcaaagtctcagctaatggctcatatgtatttagtattcagtgcagctgaactgtaattctgtaatggaatttgaccaattttgagaagccagtttgtaatgtatgaattagtggagacccatacatcttgacgtttgctgactctgccagatgttggttatatttctgatggaaagaaacagagagctggctgggatcccaaatcttagaattgctaccggccgcctaccactgccacatgttgcagtggtaggagataaacatgctgaggataagacctgaaaaaaaatcactctatatcagcaactggagatacagcccatactccttatgaaatattctactctcgtggcctgggttgaaccatgtatgaggcaggcactccttttagcccaggcccaagtctgctctatgcagtcttcctcatatcttgtttccctagagttaccacttgaaggcattccttattcgtaatgtggtgatgattaatggcacctacctcatgggcttgctgtgaggtttcaatcagataatggatgctgaaggcttagactgtgcctggcatagagtaagtgctcaataaatggtagctagagttcttttattatgcaatagaagcaggactctgagggtaacatcttaatatttccagttgaatgttatcaaagtcagttgttcatgcatttgttaaattatgggccatagcaacccaactctatggacctgggctgctgtgtcccagactgtaattaacacacagttgcttatatctgtcttttcttccaagtgaggacagtttgttatgacttgtagattaagcaaaattacttgcttctccattgtgtgctaacctggtgtagaataccttttcttgtctgtcttatttaccatctctcttactttcaaatttctattataattctcctttagattacatatagctaacttaagaaagtcccagatgtgaaaataaggcgagtgcatgatgtatcccccttcccttgatttttgctgatcaggtggggaatctgacccaatagctcttcttctgtatcctttcttccctttcagtggagtagttcacatgggatattatctcctttacttgtcttttactactaaaacatttcttttaaccatcttcctcctttgttttccaagttttgcctgattacatcaagaactacctcctcctcctcctcctcctcattctatcccatttgaaagccaaacacatgaattgaattgtaaatggtaggaaatagagtattactattgagagatgtgtaccaaggcaaaggaaagccatacattaaaatgagcaaggggaaagtagtatttgaattcccaaagacatctcatactcactatgtccaaatctgaaatcactctctatcttctttaagccttctcctgctaaagtcctctggaactttgtggcagcctactctcaagatgtttcaccagtgggtttatttcattcttcttactcctactattcttgctctgggcctggccctcatcatctttcatcttgaggtaataacttctttcctcatctttttgtaccctctctgccctggatggcctatatagtggcaaaagaaggtgttttttttttctttcctttttagcttttttattgtaaaatgagacaagaatttaaaaaatcaaacaaatgtgtagcttaatacaatattacaaggcacacatacttgaaatcaccatccagatcaagcaatagagctttgtcagccaccccagaagtccttccaggtgccctctcccagtcaaaaaccttctctccttctgaaataaccattatcctgacttttaaagtagttatttccttgcatttctttatctatagacagtgctatttggaaacaccagtcttgctgcatccagttgcctctatgccaaagtctagaggtgcgcaaattccctaatgggtattcttttttgaaaaattattttaaaatatttaattgacaaagattgtataaattgaaagtgtgcagtgcaatgtgatgatttgatatacatatatattgtgtaatgattatcacggtcaaattaattaactcatctaataccacccatggtgtacattagagccccagaacttgttcatcttctatctgaaaatttgtgccatttgattattttcctatctcacccccttatctctggaaaccactctttgtttctgggattcagcttttctaggattccacatataagtgagaccatatagtatttgcctttctgtgtctggtttatttcacttagcataactgtcctctaggttcattcattttgttacaaatggcatgattttttttttgtttttttaatggtgaataatattccattgtgtaatatataccacattttctttatccatttatctgttgatggatacttaggttgtgaccatatcttggctattgtgaataatcctacaatgaacatgggggtacagatatcccttcaagatactgattttatttcctttctctccggccctcacaggttttctcaggcctacatttatagtctcctgttttgttttgttttgtttttgacatgaggtcttgctctgttaccaggctgaagtacagtggtactatcgtggctcactgtagcctcaaactccccaggctgagcctcctcccagctcagcctcctgagtagctgggactacaagtgtacgctaccatgcctggttactttttgtatttttttgtaggacagagtcttgatatgttgcccaggcttagtctcctttctatgattccccctcccctccccctagtctctgtccgtaccacgctatttataggctgctagatacctcaggtacctcttggtgtttgccagatgcctctaggtattggctcctgttgttccctttctgaagctgccgctcttccattcactggtgaaatcctagacccaactcaaatgtcatttcttctgtggtatgctgccctggatcttccttctctgacgtacctggggtagaacgaattcttcccgtccctgtgttctgtgtccattatagcattttacacttgcttctattgttagcatttttcagtctttggtacctaacagattttttgtaggtgctcaataaatgttctttgaatgaatgaatctatgtaatccatagttaaaggtctttcagggtgtcagattttcttcagaatcaacaaaaatatcttgttttgattttcacacaaagttaaaaacatattaattttattttctgtccgtaactattattgccaatatttggctttactaactttgtgtgataaatatttgctattttggccacattattggtaaaatagacctttgtgggcttttctggctacctgcacaccatttttattatttcaagggtaacaataattattgagtacaacagtgtgccagacattgtgctaagctttgtctgtgcattatttgctgactcatcaccctaatcctttattattttcattttacgtgtcagaaagtaaaacttagagaagttaaatgagttaaagttataacgctaagaaagggtagattcagggtgcaaatctaggcagtctgactataaatgtaaaacccattttttttagccattatttttttgtttgttttttcctctttgagacagagtctcacttgctctttgtccaggctagagtgcagtggcatgatctcggctcactgcaacctccctcttccggtttcaagcgattctcctgcctcagccttccaagtagctgggattacaggcacgtgccaccacgcccacctaatttttgtagtttttggtagagacggggtttcatcacttttgcctggctggtctcgaactcctggccccaagcgatccacccttcttggcctcccaaagtgttgtgtttacaggcatgagtcactgggcttggccgttttttaccattctgtgttatttcttattaagaaagataatagttctcagtagccaacagtggacttttgcaaagcatctgtggagcacagctcatttgtggaagtttgctacccactgccgcactgggacgcaagtcaattctttaacattttcattcccccttccctaaattgcttctgtgcaaggccctgtccagctctactgatactaggtgtgtatatcttgtggtgaatgggtggcagcttggttaatgactcttggtgagccggaaataacaaggttgctcttatattgacatgtctcttcttagccgcatatattatttagcttacggctactgtcttaagggttatcatcactataaatgatgtgttttgtgcctggcaaggtcataagttgtgtcttctaaaatgatattggtcataaatgttaattgctacttcttaacttccctttgaggtgttacaaggaaatccacgtatgaacaactgaggaagcaattaagcagaagaacagcagcacaggaaaatccaatagttggtactgcacataggcccctgggcttacagaaactcagaccaggggccccagaggaattgcctttgaaatagcagcagtggaggctcagccatttggggaatcattgatggtcattggtagatggcacagacgaatgaagtctagtctcacatgagtgtttgtcctgtttccctcattagcatgtcacttttccaggtcagaaattgtagtctctctttggttgagccctgtgccccttaatactgcccagtcctgcatatggcatagatatggcattgttcacctgcaggcatttcttgtctattttaaataaccctcttactgcattttggttttttaagtcagttttccatttaagcaaattgccaaggtttatctagaatttttggttgtgtaaaacttagctgcagcagctaacattttctgttcctctagcaaatgccaggtgctgtttaaaacactttctacatcgttacctcctggagtcctctcaaatcctttgaggtaggtactgttattctccctgctttctagctcaggattaaaattggcatcacttgcagcttagaagatttcttgttataaataaagaaatgtgttagggagatgtggtgatgcccacctgtggtcctagctacttgggaggctgaggcaggagaaacccttaggctcaggcgttcaaagctacagtatgtgatgatcttgcctgtgaacaggcactgcacttgtgcctgggcaacatagttgagatcgcatctcaaaaaaaattgttgtattgggatttcagccgcactttctgcctaaggtactgccttgtttggaaagggtacttgacaaacatctgtgtggctgggagggtgcttctagagatagtgatttttctctaggatcagttatataataattttgggaaaaaacacaccatttttgttttgttcttgttagagaagtggctgtagcattttctttcaatggacactttatcaacagcttttctaggaagttttattttattgtttttgtgggggtgagcttcaagactatatttgctgttgtttcttttcccagactaccctacttcctactgtagtgtaagtactgtagaaggatttagtaactgaaggtcagcagtttggctcttttgttaattcctgatgctgcagatgaagtaatgtgttttcttgtcagataaaatgtataaggctgctactcagcttgacaggaagaatgagctagaagtacttctcaaagaaaaacgtctcagataacttctgacttttcctttttcacttcctaacgttgttctcctgtatcctgctctactcctaagaaggtatgtgatttgggcaattcatttaatctccctgtacctcagttcccttatttataaaatactgaaaacaagcaggttcctctaacaattttatgagataatatctgtatagtacacatcacagggactggaatatagaaagcactcaataaaccttagctattattagcaaccacttgaatataaaaatgtacacttattcaggggcctgaatgctctccaggttcatgctccaggagtattgtttttttattttttattttttttgagacagggtcttactttgctgcccaggctggagtgcagtggcacaaacacagctcactaaagcctcaaccttctgggctcaagggatctttccacctcagcctccgagtagctaagactacaggtgtgtgccacctcgcccagctaatttcttttttcttttttttttttttttttgtggagatggggcccaggctggtcttgaactcctgacttcaagcgatccgcccacctcggcctcccaaactgctgggattacaggtgtgaggcactacgcctggccaaattggtgttattagtctcaaaaggaaacctaggttgatatcctgcttaccctaaggaaggttcttcagaggtgttttactgttcttggctaaagagcataagaagggcagtaactaaaagaactttagtggccagatgagaaaccaggtagttactggaaatagatattataatatctaaatttgtgcaattttattctgagaatatgacatttggtttcatcttcctacagtggaaccaaatgaatgggtaactaaaagtggtgtgatggagaggattgagtcctaaatttgtgtagtatgctcttccatcaaggattgagattagggggaggaggaggtagtaggtgagggaagaatatttaaataagatgagacatttggctggtcttggaaattgatgtcaagattcatgccccacctgctagtaaagttaatcaagaccagataaatcaggaagcctcactgtagagcagatttcattcattttacctctcccttcctctcctcaaattccccacattgtgtctgattatagccagatatggctgggcgttctaagcctcacctccggagattggtattcactaagtttggcctgacacacagagctctgcattttgaacaagttccctggggatgctcctgcagaccttctcagaagcaccttttgagaaaacctggattcaaattaaggcccacatatcgccataattggtcagtctggaattagcattgagttttggcatctagccacacacattcacttgtcctcttgcacttttgccaaaatgggaacaaatgcatttctctttagtttgggaaaatcaactttttatattaatgtggttgctaataatagctaacgtttattgagtgctttttatattccagtccctatgatgtgcactgtacaggtattatctcacagaactggtagaaaaacctgattgtgccaggcgcggtggctcacgcctgtaatcctagcactttgggagtccgaggtgggtggattacctgaggtcaggagttcgagaccagtctggccaacatggtgaaaccctgtctctgctaaaaatacaaaaaaaaaaaaaaaaaaaaaattagccaggcatggtggcacacgtctgtaatcccaggtactcgggaggctgaggcaggagaattgcttgagcctgggagacggaggttgcagtgagccgagatcgtgccattgcactccagcctgggtgacagagcgagactctgtttaaaaaaaaaaaaaaaacctggttgttttctatattctgtaaataaggaaactgaggtgcagggagataataaatgagttgcccaaattacatagctgcttaggagtagagctggaagtttatccaaacaacctacttgaacctgtactcagtttttgttcttaattggtctcgggtgcatggagttgttggctgcactttaactgctacactgcactgtctttggagccaatcaacttttttttttaatgtttcagaaacaagccaatttacttaaaattttttttttttaaattgtagtaacatacatgtaacgaaatttaccatcttaaccttttttttttttttttttttttgagttggagtctcgctctgttacccagcctggagtgcagtggtgagatcttggctcgctgcagcctctgcctcccaggttcaagcaattctctgcctcagcctcttaagtagctgctattacaggcacccaccaccactcctggctaatttttgtatttttagtagagacctgtttttgccatgttggccaggctggtctccaactcctggcctcaaatgatccgcctgcctcagcctcccaaagtgctgggattacaggcgtgaacccccatgcctggcccatcttaaccatgtttaagtgtactgttctgtggcattaactgcattcacactattgtgcaaccatcacaactctccatctctagaactcttgtcatcttgcaaaacaaattctgtattcattaaacaataaacttcccgttttcttttctccccagcccctggcaaccactgttctactttttgtctctatgacaaagccaatcaatttttgtgttaagtgtataccattaatctctacagccagtagctttctattgaattttttagataaaaaaatttacaagtcaaaccaggatttataaacatatactcagtattgaaacaagaagccatagacattttaaatagaatttagcatgtctttaaaaatgtgtaattgtatcttttaaaggacttgaagtctgctccactatgtaatacaactagattaatatttgataacttacacataagaaagctgcactgaaaggaaaaacaagccctattgctgggtggttcctttatgcttgagaaagcagtttctttggaaaataaatacatttgtgatcacatgaattaatgcaaattgctgcatcaggctaaaaatccattatgctcagtaactttaatgagattgtacattttgggatgctttggacagagcaaagcaatacatattaaaagggctgattttgaaagctgaagccccacttttcctcctgtcaattttttttaagttgaattgcctacaggttactaatatttagaaagctgatttgcgaagctggaaaccatcattctgagcaaactatcgcaaggacagaaaaccaaacaccacatgttctcactcataggtgggaattgaacaatgagaacacttggacacagggtggggaacatcacacaccggggcctgtcgtggggtggagggagcggggagggatagcattagggagatatacctaatgtaaatgacgagttaaggggtgcagcacaccaacatggcacatatatacatatgtaacaaacctgcacgttgtgcacatgtaccctagaacttaaagtataataataaaaagaaagctgatttgtgtggttacacaggtataatagttttatttcaagcttttgaagatacagttccacccctccccccccccacatttttattttatctttctgggaaaatcctgaacctagaagcttcttttataaactttgttctgtgtcagatcattaatttgtaagcttgatgtagacaatttcagatgctgttattattctgaaatgtactatggttgttatcaatttttagctgtttacacaaagcattattatgttttaattttttaggctatcttaaaatacctgaattgtgtcagccaaatagggactgaagggtgctttataataacttaaaacttagatccttttttacctaatgataaaatcagtaggagtgtattttttcattcagggtcatctgtctctttgattctctttcatttacattgtatgtaatcaggatatatatgattttaaaaatttgacaattagtcatgaggatttgttttaaaattaaaaagtattatatgtggttaaaaatttttaaacaggtcgggtgaggttgctcacgcctgtaatcccagcactttgggaggccgaggtgggcagattgcttgagtcctgtagttcgagaccagcctgggaaatgggaaacatggtgaaaccctgtctctacaaaaaatacaaaaaaattagccaggtgtggtggcacacacgtgtagttccagctactcaggaggctgaggtgggagaatcacctgagcccatggaggttgaggttgcagtgagccaagattgcaccattgtactctagcctggacaaccagagtgagaccctgtttcaaaaaaaaaaaaaaaaaaaagcgggggtggccaggcacagtggctcatgcctgtaatcccaggactttcggaggccgaggtaggcggatcacttgaggtgaggagttcgagaccagcctggccaacatagtgaaaccccatctctaccagaaaatacaaaaattagctgggcgtggtggcgcacacctgtaatgccagctactcgggagctgaggcatgagagtcgcttgaacctgggaggtggaggttgcagtgagccgagatcacgccactgcactccagcctgggcagacagagcaagactccatctcaaaaaaaaaaaattacagaaagtgtaaaaaagtttatatccacacttcattcaaagccctgttcagtttcttatctagactttcatatggtttttatgtcagtctaagtacacacacacacatatacacagtgcgtgtatcttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagcagagacggggtttcaccgtgttagccaggatggtctcgatctcctgacctcatgatccacccgcctcggcctcccaaagtgctgggattacaggcgtgagccaccgcgcctggccgcgtgtatctttttatacacagaagaatcatacaattcttaatattcaatttagtttttaacttactatatattacaaattatttcatatgggtatttacgtagctactcataaatagatgtcccacagtattccaatgtttagatattccgtagctcatttaaacagtcttctcctgagggacatttggattatttaatttgtttgttttactattataaacagtgctgtcaacagacatccttctacatttttgtttactcatgtttgaggaatcacataaaaacttttttaaagaaaaattggagtaatgatattgaaagtttatacattttgctgtttgatagttcctaattttaaaaaagccagtgtaaaaataacatttggaacaataaaaatgaaaaccagtatcatatacttgaacatagataactaaacatacgtgtaaatattttgaataattacagctatcatttaatgatcaccaatgtactgtatttacttctcacaacactatggggtaggtactcttttaaaaaatttttaaagcagctttattgaattataattgataaaactgcacatatttaatgcatacaatttgatgagtttgtacatatgcatacacccatgaaaccactacaactaaagtaataaacatatctattgcctccaaaagtttccttatgcttcttctggtttgttgttgtaagaacatatgacatgaagtgggatcatacagttatttgtttttctgtgactggcttatttcatttagcaaaatgtcttccaggttcattcatgtcacaatgggaggatttccttttttaagaccaaatggtattcattgtatgaatatatcacatttccttttttttttttttttttgccagtctagttttacttattatctcttcatttcccacgttcaccttcccagaacttattatattatattattattattattattattattttgagacagagtgtttctctgtcgcccaggctaaagtgcagtagcatgatctcagctcactgcaacctccacctcccaggttcaagcgattcttgtgcctcagcctccccagtagctgggattacaggcatatgccaccatgcccagctaatttttttttttttttttttttttttagtagagagggggttttgccacattggccaggctagtcttgaactggcctcaaccgatccacccaccttggcctaccaaagtgctgggattacaggcgtgagccaccgcgcctgcccccataactaattttaaacaatttctaaacatcatatgattctattcataaacacttcagctatcattattatttaacataggaaatattaacatatattatgggtacaaatgctataatatttaaagcacctttatgttatgatattaaatgtaaatatttgtttaaattcctggctttccttggttcatcaaatcaggtaataaattaaccagacaggttccaattcaatcagatacgaatataccacgttttctttatccattcatctgtcaatggacatttgggttgcttccttatcttggctgttgtgaatactgcttcaatgaatatggaagtacagatatgtcttcaagattctgattttaattttgtggtgatacacccagaagtgggattgctggattgtatggtaattctatgtttaattttttggggaaccaccatactggttttcatagcagctgcaccattttacattcccaccaacagtgttacaagggttgcagtttttccacatcctcactgacacattttatcttttgatttttttgataatatccattctatcaggtctgaagtgatacctcattatggttttgatttgcatttccttgatgattagtgatgttgagttccttttcatttacctgttggccattgtatgtcttttttggagaagtgtctattcagttcctttgtctattttttaactgggctatttggttttttgctattatgttgtaagaatttcttttttgttctttttttttttttgagacggagtctggctctgtcacccaggctggagtgcagtggcatgatcttggctcactgcaacttccacctcctgggttcaaacaattctcctgtctcagcctcctgagtagctgggactacaggcgcaccgccaccacgcctggctaatttttttttttttttgtacttttagtagagatggggtttcaccatattggtcagactggtcttgaactcctgacctcaggtgatccacctgcctcagcctcccaaagtgttgggattacaggcttgagccaccgcgcctggccaggaatttcttatatattttagatattagccccttgtcagatacatggtttccaaatattttctcccattccataggttgcctattcgttctgttgattgttttctttgctgtgcagaagctttttagtttcgtgtagtcctacttgtgtatttttgcttttgttgcctgtacttttggggtcatatgcaaaaaaatcattgccaaaaccagtgatttatttttatgttttcttataggagtttcagtttcaggtgttacatttaagtctttaatccattttgtgttgattttcatgtatggtgtaagataaaggtccagtttcactcctttggatgtagatatgcagtgtgtccaaaacagctcattatcatctccactcataaatctggtttttctgtattccctttctaggtgataatgtccccatttactctgtcatttaagcaatacacctctaagtcttttcagttctttttttaatctctcttaactccttctcctcttccattctcatggctgcagctttggtccaggccctcaacagttatcacctaggtaaatacagtcatatgtgccccagtgtagcttgtccagccttgcctcttgctatctttttcctcatatgtttttcttcagcaataggtgaactccttgtgggtcactcagtcaccccattccatctcctgcccttgggcctttgcgcatgctagctgctctgccagatcctccctcttacttcttagcctgtttaacccctactcatctttgaaaggcttgcttcaggcatcacatctaggaagtctctgctgacccctgagtttgggcttaggcactctttttcctcacacttgcctgtagctcctctgatgttatattcaccacactgggttataatgatctatttgggtgcctgtcttctcttctggattgtgaattcttggagactgcagccatggggaaatctattgcatttttctgtgtgtgaatgggagtggggtctctcctttagtcataatgtgtccttctcagggaggccttcctttgtaaccctatctaaaattgcaacctcccccaacacttcctatcccccttccttgatttattgttctccttggcacttattgctgtctaccatactatagattttacttatcttgtttattgtctgtctcctcccactagaatgtaagcgctatgagggaagggatttttgtctttttttaaactgttgtgttctcactgcctaaatcataccaggtatgtagtaggcacttagtgaatatttgttgaacgattcaacaaattcagctgcctctgatagtaaattttgttttgttttgtttttgaagacagggtcttgctctgtcgcttagtctggagtgcagtagtgcaaacacagctctctgcagcttcaaactcccaggctcgagtgatcctcccacctcagcctctcaagtagctgagattacaggcatgcactaccatacctggctaatgttttttgtattttttgtagagacagggctttgccatgttgcccaggctggtctcgaattcctgagctcaagcaatctgcttgtctcggcctcccaaagtgttggatttataggtgtgagccaccatgcctcgccagtgtattgttaagagtgtagtgtttggagccagactgttagacttcagattcttccggcgtctttttttttgtttgtttttgaaacagggtcttcttctgtcacccatgctagagtgtggtggcacagtcgttgcttaccacagcctcgacctcacaggcttaatgtgatcctcccacctcagcctcccgagtacctgggactacaggtgtgtgccaccatgtccggctacttgttttattttttgtagagacggggtttctccatgttgtctagactggtctcagactcctgaactcaagcgatcggcccaccttggcttcccaatgtgctgggattataggggtgagccacgatgcctggcttcctgaagctttttatctgtgtgatcatgggcaggtcacataatttctctgtgtctcagtcttttctgttttttttttttttttttttttttgagacagagtctttctctgtcacccaggctggagtatagtggtgcaaccttggctcactgtaaactctgcttcctagattcaagcgattctccttcctcagcctcctgaatagctgggattacaggcgcgcatcaccacacccagctaatttttgtatttttagtagagacagggtttcactatgttggtcaggctggtctcgaactcctgacctcgtgatctgcccgcctcagcctgccaaagtgctgctattacaggcatgtgccaccgcgcttggcccttttctgttttaaaatgggactaatagtcatctttactgcacagagtaaatagttctgtataacatattacaagattacctggtatgtggtaaacattgaaaaagtattacttgtttttattcctgacttggaaagttggccttagagatgtgtttatcttggcatttccagagcctggcctggtagtgcacacctgaaagtatcaaataattctttgtaagataaatgtttaaatggaatttaagcagatttttcaaaactattgtttttgtcttatttatttatttatttattttttttggggacagggtctcgctctgtcacccaggctggagtgcagtggcacgatctttgctcactgcaacctccgcctcccgggttcaagcgattctactgccttagtctccgagtagctgggattacaggtgcacgccaccacgcccggctaatttttttgtatttttagtagagatagggtttcaccatgttggccaggatggtctcaatctcttgacctcgtgatccgcccgcctcggcctcccaaagtgctggaattacaggcgtgagccaccacgcctggcctgttttgtcttctttaaattagtgttttggatttttgataattaatcatagcagtttgtatttaaattagatatgtgaatacctaaaggacaaaatcttaaaacatcctgtttttctttttttgagaatctcacgccattgcccaggctagattgcagtaacgtgatcatggcctcgaccttctgagcttaagtgatcctcctgcctgagcctcccaagtagctgggatcacaggcatgtgccaccatgccagtttaattttttttaattttaattttgtagagatgaggtcttgccatgttggtcttggactcctgggctcaagcaatcctgcctcagccttccagagtgctgggattataaacatgagccacagtgcctggccttaaacattttagacaaaaatgggaacttttgagctttgactttgattagacacagtaagcgcactcatgttctaaggctagaagctcctttaattttctgtggaatgtggatactgttgtagaattccaggctgtgcttaagctagtggatctgttccactttttaactccttgcttcatttttaccagctttagagccctatgtctttgtagccaagaaagaaattagtctaggcctgtaaagactcacatctagttaagatagacaagtcttcagttttcagtaatatgttgcaaaaaaggcagaaaactactcatcttggtttcttggaaagtgaaactgtatgtgtactaagctccatctgtcaaaagtagtatttaatactttttccttagcatcttttcagaaaatgggagcgtgggtgatggtgatggaaattaacatttacggagtgccaactatgggccagacactatatgtatgttattttgtttaaaccttataggaatattgtatgtcccaatttacatataaggacactgaggcacagaatggctaagtaacttggcaaagatgacatatcttgctagtaagtagcagagccagtgttttgatctaaaatcttttttactgtcactttccacatctgccacacacttgaacaagaaaatgtacagttgtcattcatcttgaatgttgataatttgtcttattgtcaggtttttgctactttcaaaaattggcacaaaggtaaaagaaccttgcatttcttgaagttgagaggtttgtggttccatttgtaagaagttaaatcctaaaaatacactgtaaagtatactaaatgagcaaattaagcattaatagctgtaaaactgtacatttatattatacatactgatttatgtaatatataaactaaaaattagaggtgtgaaggatccttaatatggtcacatatgtttcagttatcctaaaatactttttttgctaatactcttttcgtttttcttccttttttattttttgaggcagggtcttgctctgtcgcccagactggatggagtgcagtggcttgatctcggctcactgcagcctcaacctccagggtgtaagcaatcctcctacctctcagccttccaagtagctggaactacaggcacgcaccaccacgtccagctaatttttgtactttttatagtgacgaggttttgatatgttgcccacgctggtctcaagctcccaggctcaagcaatccacccacctcagcctcctacagtgctgggattataggtgtgagccaccacacccagcccactaatacttgattcttaaaaaatattttaagaatgttttttcttatggcttcaacattctttggaaatgtactttccatcagtaaaatgttcctagtttctactctaactctggagcagtatttgtatgtgtcatcaattgtttaaatttgaatcaagcatcagtaatggcataccatttgggctgctttgtggccctgatgaatgctattttattttatttattttttattttattttaattttgaggcagagtctccctctgtcatccaggctggagtgcagtggcccagtctcggctcactgcaacctcctccccctgggttcaagtgattctccttccttagcctcccaagtagctgggactacaggtgcgtgccaccacacccagctgatttttgtatttttagtagagattgggtttcgccatgttggccaggctggtctcgaactcctgacctcaagtgatctgcccacctgggcttcccaaagttctgggattacaggtgtgagccaccacacctggcctgtgaatgctattttaatatagttctcaggaatgattaaaaacaaatgtgtttttctaagtggtagaattaatagataaaatcactttgaaattaaagtcctcaggtaacatagaattcttttccctgaacaagtcattatgtagcacatggtataattttggcagacccaactttattaccaacaaaactgtaaagcgagtcctatgtcctgtttgtcttttcttctcgggggtttctgttcttactagaacaaatcaaagtacagtgtgtgttgctggtcttcaagaattattagtttttgttgtaactgtttaatgcagaaacagatgctagagcagttattccccaaggcaccatgtgcctaaggcatttttaaagcactagtatgttttcagtgtgatactgctactctggaagaactgtatacatagtggttcacttttccagtgtggttagaactgacatttctaagatataaagaaatttaaggccaatttggatttgtactctggctctgcttcctgcttaggtggaagactttgagtgatttagttatgctctctgcctctattttctcctcttcaaagtggggatgatgaaacctactttataactttgctgtgaggatttgtttcggaaaaactctcaaatcagctctgctctcacaccaacaacacaacaacaatcaacacagaagacttccgtgacaaaatgtggggattttttccaatacactaagcagtgaacaccagctgtgtcctctaattcaattttgacaccatctttctggagatagcatcagatcccacaggtagagggcgcagtccccaaaattgccccctctcccaggcaccagttccaagtctgggcctctgcaacttctgaccgaggagcttcaagttgaggttcccatgaacctctccttgggtttgattactttgccggagaagctcacagaactcagggaaacacatttactggtttattacaaaggatactgatgaaaaaatgtgtagggcgaggtatgggggaaggagagtggagtctccatgacctccctgggtgtaccaccctctaggaacctacatgtgttcagctatccagaagccctctgaaccctttctgtttgagtttttaatgtattttatctaaatacaaccatgtagaaatgtgattggacaaaaagctcatgatctaaacccagcaaggcttgtctgttcagacttttcttggctactctgtgtagcattccttcccttagggtatgggacagggtcctctttggaatgagtgtctgttgataagagtcttcccttgggcaggtgaaaggaagacaggagagggtcagagagatctgtttcctgaggcctaaagtgccccaacattataacaacagattatgacaagggttatggaagttatgagctagaaactgtggatgaagagggtgtgtgtgtgtgtgtgtgtgtgtgtgtgtgtataacaggattattatctaggactacacgaatttgatttgtgcatttgcttaagacagtgtaatactgtgttaggtatgcaggcttgagagtcagtccattgagatacaaattttggcttcgctcctttttagtcacctgaactaggatcacccacataacctctttgtgcttcagtgtcctcatctgtaaaatggggaaattaataactacctacatcacagagttgttacaaggcttaaatgagtcaatacatatgaaatgctttgaactccacctggtaagtcttcattaaatgttaaatattattaatttctttaatattgttatctccacttgtcagcatgctatgtcaacattcattcactatgttcactaaactgagacttccttgagaacttggccaaaatcagtatttgtatctcctgaacctgacatatttgtacttaatttaaaatgtttatgaaatgaataaaatagtgagggaataccttcatgcttctcagatctactctttttcttctttccatttcctttgaaactaatctttctcacgtgactcatatcatatttgaagctggactgtctatgttttctagaacaaaaatttgggatacttggtctaaaaacagattagtcttgttaaggctgccgtactacttatcacagtcccatattctgtgtctcattagatgtatttctcctctcctacttcttcctctctggtccccaacacacaatgtagagtctggggcattggggcgtagaaatgcttgataaatgattattgacttgagcaaagagtctacaggggtgattcagggcatgaattaaccttcctcatgctttgatctcagatggaaatagagctgctcattcacaccagtgatggtttcaaggttattaggagctgcggtatctgaatctggcttctttttatttttattttttctgagacggagtctcgctctgttgcccagactggagtgcagtggtgtgatctcagctcactgcaacctctgcctcccgggttcaagcgattcttctgcctcagcctcacgaatagctgggattacagatgtgcatcactatgcccggctaatttttgtagttttagtagagatggggtttcaccatgttggccaggctggtctcgaacttctgacttcaggtgatccacctccctcagcctcccaaagtgctgggattacaggtgtgagccactgcacccagcctgaatctggattattttgaagtaacacatttcgaacctcaaatgaggtacaggatatatgagacccagaaacaggcatttgaaaatattctgctttgtaaaattagatatccgtgcttttcttcaagggtattcttttctcctatctcttaaaacctgtatatctgtttttttaaattttctatttcaagtcctcaaatggtaaattagattggaaataattcattggtaagttgcagtcactatgcaaggagagttggcataaatggtgcagttttactcttgctgcatctctctacctatagcaacatagaaatatcttttctaattatagtcatgaaaagtctaatgaactctattctgttttaaaaaagccttttccattttcttttgttaagcactttcttttcttttttttttttttttttttttgagacggagtctcgctctgtcgcccaggctggagtgcagtggcgggatctcggctcactgcaagctccgcctcccgggttcacgccattcttctgcctcagcctcccaagtagctgggactacaggcgcccgccactacgcccggctaatttttttttgtatttttagtagagacggggtttcaccgtttttagccgggatggtctcgatctcctgacctcgtgatccgcccgcctcggcctcccaaagtgctgggattacaggcgtgagccaccgcgcccagccaagcactttcttttcatttgtgccatatatattgttgaaaattggcatttatatacccttctggctttaaacaattggttccattttccatgtaactagacacaaatgcattatgcaaaattgtgtttgtaaggagagatcatccttcattccgtttcataaaggttttctcttttttactgtttacgtgagggttgaatatgtctgccttctggtaacacattaaggttgcaatatttgtctagttgtaggaatacttagctcttttttgtttgaatttgacataacacatgggtaaatctaatcctgatggaaagttccatttaatttttttataacaacttttaattgacacataatgtatttatggggtatagagtgatatttcaatacatgtatacaatgtgtaatgatcaaatcagggtgattagcatatccatcaccttaaacatttatcatttctttgtgttgagaatattcaacattttctcttggctatttgaaaatatggaataaattattaattgtagtcaccctacagtgctatagaacactgtaacttattcctcctgtctagcagtaattttgaatccaagagccatccctcctgcctatccttcccagcctgtagttgccgctattctgctctctacttctatgagatcagcttatttagaaagctccctttttaaacacataaaaatatttttgtagtgtaaaaccaatatatgtacactgtaaaaaaaagtttgtcttaatcagcttaacatatgtttgaatttaaaaaaaatgtaattatcttaaagtttcagtttctaaaatcaaagtaaagtactaataccagtgcttcctcatgtatactcggttgagtttcttttgggggtgatgaaagtgttttagagttagattgtggtgatggttgcacaatgctgtgaatatgttaaaaaccatggtattattaaatgagtgaattttcatttagtatgtgatttattaataaagctgttttatgaaaagggtactcatatcactatgaatcagctctatcacttagtagctggctgtgtaataaccttggattaagttgctttcatttttttgtgccttggcttcctcatctgtacaatggggataataatatcttttttgttggttggttgtgaggactaaatgaataaatacatgcaaagagcttagaattgttttttgaaacataaaccctcaaacgtcagtggttgttattattcttatattgcatgtatagttcagaagagaagtctggggctgtagatacacctttttggtgtgatcaacataaagatggtaattaaagccacacatgtggattaggaaacccagggagaacatgtagaatgatgaaggacagagagctgagagccaaatctagagaaatagcatcatttaatatgggagcaggacaagcatatctggcaaaggaaactgagaagtcatgtccatagaggtgagacaggtgtagtgttagggaaggaaaggaaaaaattgtcttccaagaaggagaatatggctaatagtgtcttgctaaagagagtttatcttagtctaatttgtgttgctctaacagactgggtagttcataatgaaaataaattgatttcttaccgttctcaaaggccgggaagcccaaggttgaagggcctgcatctgccgaggtccttcttgctgagttgccccatggcagaaggtggaagggcaagaaagtttgagagagcaagagggcaagagcaggagggagccaaattaatttttataacaacccactctaacaataatctattcatgagggcagagcccttatggcctaatcacctcttaccatcctggtcccacctcttaataccatcatagtggcaatcacatttcagcatgagttttggaggggatatccaaaccataactttctgttcctgaggccctgaaacccatgtccttctcacatatgaagtatattaattctaccttaatggctccaaaagtttttttttttttaatttaaaaattttctttttaattctcagcaaggcaaggtacttctatatagaagggtgcgcccttacagatggaataatggtgagcgtacacttggacaagggaggggaaggggttcttaccctgacgcacgtggcccctgctgctgcgttgttcccctattgggtagggttaagaccgcacaggctaaactaattccgattggctaatttaaagagaatgacaggatgagtgctttggcgggaatcagggcagagcaggtagcaggtaatcggaatgagttagagtggagcaggtgatcggaatgagttagggtggagcaggtgatcggaatgagtcagggtggagcaggtaatcgaaaaagattctttacgaggaagttaagtttaaaagtagaaggaaaagaattgaacacactgacatattaattctttgaaaagaaatttagaactcatatctaacagcccctccccttgtatttccttacagctttcttttcaaacttttaacatgtcttagcttagttgttttgcttgattttctaaaagaagaagcttctctggataaggtggaggatagttaagggaggttttagtaagtgctatttttatgagcctctgcatcaacttacgggtgcatggtatgacacagcacccgacaagattaagtacactcattatggctgtgagagaaataagaattgaggctattatttctttccgtttaccgaactacttttctagccatcctgtaaagaggtcatttacccctgagttgctggctgactcattggatagagcagtcagaccttgcaatgcctttgttatacttccattaggggtggtggtgtttgggatgaagtgcaacattgagttttaatcatgatgcaaactcctcctctttctgctaatatcatgtctaaggctgtcctattttcccaagccatctggctagtagcccctaattgttcagctattcctttaacagcatctctagtgtagttaataaatcactgttggttgtaatagatgtagtttatccaatctacatttttattaactgtcacccaccaaaatattgacaaatcctgcagctatttgatttcgggctttaaattgatctggtattccccgtgggactccaattgcatctaaatagacgtgagagtcaaaagacccataaggtacttctctcgctttatgatgtcttatttttcctcctcctggttgatgaaatgccagggtgaaagggatagccaattggactaaagcataagtgccacttcagttacttggcagagtgtccagtaaaggtccaccataataccactacacatctgctcagggatgaataaaggctgactgattggtaagcttttgacaattcttaagctcactacatcccttcaggtctccaaggagtgataagtttcctccctgtcaagggagacatgaagtgaacctagtgttgggagacggaagctggatggcccttgggggctgacccgcagggtgccgaacttcaagatatagcagagagagagcttggcacgacttattactctaggctgtagaatcctggaaaagagctaccatgcagtccacgcctggtcgactggaggaccaccctagtggaaaggggacaatctgggcctctggcctgccgtgcgcacaagaataacaattgctttgttaaacgtgtggtcggaatttttgatccattccaaccaggcatttgcatcttggtatcctgtcttaattgccaaagtttgttttaagtctttaacttctatgatcctctcgtaaaatgaatatatggttttaggaaattacaaaaaccaactggggcagtccacccttgctctttagtggtccacagaacactggaccaactacgatataaaggtctacatcggggggcaagcctcctggttgacactggggtctttatcgaaatctccccagattaaatggtcccaatttactaatgtccagtctgaggagagtcaggagggacagaggtacttttctgaagtagagagctgtctttgacttggcaagtccccacagggtttaacaaggcaagcattaaatgcaatagtttgaggcaaaattgacttggttatgttaataactaaatggtcaggaatagagcgaggaaagaagaaagagtaatagatagatgaaagagttaaatttttcttagctttagtttggtagggttttctcctgggactagggcccacaactctggagggggtggcgctttcttgactcgggtatgatgagtccatcccttttttgctgtacgaacagcggtggttagcagcacaaggtagggtccttcccaggctggctcgagttttccttcttttcaccctttgatgagaacgtgatcttcaggctggcgctggtttaccggaaattctaggtgtggtacatgtgctaaaagacttttagttttgagggaaaggaaagtggaagataaaccaagtatataatttctaagaaactgaccttttgttttaaatgtgggtacatcagcagtggactttatagtccttggtgccttcttactgagaaatttcctgtagcacctatttttattagtttttagaccaaagaaagccaaacaccattttatatttgacaatgcttcctgtattatttttataccagataagctaaatttcacctttatattagtgtgttattaattttaaacttagttttaataaaacttatagacataatttattcaatttttaatgtctgaccataaggtaagatttttatagactctttttaaccttttataatttttgttaaagagcaggttagtgctttaagaaaaaccctttgtgtttttattttaatgtccagttcacagaaaaattggatgataccctttcaaccttagccaatatgtttgcatacagtttcctttacaattaatgttttaaaacttgcttaaaccttcaaaacaaatttttttaaccttttaatgtaggtaaaaatccacattcttatgcctccttataatccttttactgaaagtatattttactttgcttatacaccttgcaaataaactgtttctgcaatagttttacattcaggaggtctaattacttttaaattatacaacatttcttgcataaattcctttttataagacactttttttttctttcacggctttcacagacaattcttcgacatgcctcaactttctgacttattgcaaacatccctttctttaagcaaccagttatttcaggacaagaatttaccatataacattctctttacataaattctcctccccccttttttttcctaaaggtgataaccattcttttccaaagcgaacttccttcatatctgtggactagactgcctaaggccataagattagaagttaggataatacatgttacaagttaggataatacgttaacttttagcaaactttacttttgttgaaaactttgtaagtttgggatttcaattatcctttgctgttaataagaccttgtttagtccaaattaacttagaattgatatagatggttccttcctgattctgtaagtactttaaggcttagctgagtggaaacagctcatccatgtttgattagaccaattattaggccattttcctaactctgcttttacaagagtttccctgtcaattactgaatacctattgtgtctttttcactcagtcacctgggaggaaccatctattgtcctgtcctgaagggagttcctcctaggtctggtcagacctttgtgtggtaattaattaagatttagataccctgttaggaaacctgctgcgttaagggaattatccgtcgttaatgttaaatcatctttttctaacagaatagccccatactttaagatttttgagttagtaagctacctttttttttttttttttttttttttttgacttaggatagttctgaactggtgaggtgtgctcacaatcaggtttcctctaaaagttatttttttactttcttctgttagcaaagccattgctgctacagatagaatgtatttaggccatctgcgggttactgggttaaggatttttgataagaaggctacggggttgtccatggcctcagtgctttcgggctacgtccttgtttacactgacaacaaagtggtattggagtgttatagggtcacggagaagacctttaattatcaagtacaggttcctaatttaccttggcttttaaaggaatagggtacactgtttttttcttaactacttgtatatctctctctctttctctttgactttgtttctctcaatctttgactccctctttgtctctctgtctcttcctctgtctcttcctctctctctctttgcctcttctctctcttccccctctctttcttcccctctctgtctttcccctctctctgtctttcccctctctctttttctctcctctctgtctctctttctgtctctgtctctgtctctctctctctgctggtctttccttgcctctgccagccgcttatgctgctgttctcccctctccttcctcttcccctaggggagggactggcgggagtggagctactttttcttcctctaagaagaaagggggggtttgtgtgaggttcaagccttgaaattagcagaagtctcaacccctgaaaccagggatgtctcgccttgcctgtcccaggaggctcaacccctcaacaccagggaagtctcgctttgcctgtctcagaaggctcaacccctcacaccagggatgtcttgccttgcctgtcccacaaggctcaacccctcaaaccagggggtgtcttgcctgtcctagaaggctcaacccctcaaaccagggagtattttgccttgcttgtcctgggaggttgacctgtttccccccttttcccctctgaaggtcctttgcacacttcccactcgtgctgtcctctctggctgctcccctaagggagaattaggcccctgttagtgttggtgtgctggtataaatcccatggcaggatctgccctaagccatatgaggtagctatggaaccatggagaggacccactcactccatcctgcagtaggacttgtcaccatccacacaacaccgtaagcagggttgttggtgatcattcacgcatacacatatttagccctccagaatttgaccaccaaggaagtactttacggctcccgcggcttatccttccttggtctgcgcacagagtcattgccacagtatgtgaggatcctttaagctaggtcgctggccagttcccccccccccccccccccccccccccccgcattgctgagagcttgggttattcctcgcactgggtgggtcttgatttctcacccctgaggccaccacaatagggcagggtgcactgcagaaccagagaccaccccaggaggggaatgtaatcccagatgggcccccaaattgtcacatataaagtttcagtgctgctaaaggaatagcattcgaatatacaattttctttttaattctcagcggtgcaaggtacttctgtatagaagggtgcacccttacagatggaacaatggtgagtgcacccaaaagttgttgggttttttttcttttttctttttctttttttttgcatgataacatctcactgcagtgtcaatgtcctgggcgcaagcgattctcccacctcagtctcccacatagctgggactataggcacatgacaccgcagaagtcttaactcattccagaatcaactccaaatcccagagtctcatctaaatcagatatagatgagagactcaaggcatgattcatcctaatgtgaatttctctccagctgtgagcctgtgaaatgaacaagttatgtgctatcaaaatagcataggttagacattcccattccaaaagggaggaataaccaagaaggaagggataactcatccccagtaagtccaaaacccttcagggaaaacaacattaagttttaaagctaaataataatctcctctgactacatatcctgcatcctgggtacactgggatagagatttggcccccaaggcctcaggcagccttgctcctatggctttgttgggttcagtgcactcagtaactcacaggttggagtctcctacttgcagctctcccaggctgatgctgtaaactaggagctctacagttctggaatcatggtaatggtcccagtcccatatttccactatgcatttccctattgaggactctctgtgctggctccaacctcacatttctacttggcatttccctggtaggagctttctgtggtggctccacccctctgacaagtctctgcctgggcacccaggctgtctgtgacatcctttgaaatctagatagagttagctatgcccccacaactctcatattctgcacacctgcagaattggcaccatgtagacaccaccaaggtttatggcatggactttgtggagcagcagctcgatcctcacctgggctcccttgagccatggctggggtggccatggagtgctgggctggaatgcagggaggagagactctgggcagatagcctgtggagtatgccccaggtctgtcctccagaaccattcttccctcctgcagctctgggcctgtaatgggagggcagcctcaaagatctctgaaatgcctttggggtcttcctccattgtcttggtgattccttttgttagtatgaatctctgtagcaaagggttgcttggccacaccgttggtttgctccccaggaatgctttttcattctgtacctggccaagctgaaaaattaaaaaatctttctgttgtgctttttattttatttatctatttttttgagacagagccttgttctgtcacccagtctagagtgcagtggtgcaatcttggctcactgcagcctccgcctcccgggttcaacaattctctgcctcagcctcccgagtagctgggattataggtgcccgccactacgcctggctaattgtttgtatttttagtagacggggtttcaccatcttggccaggctagtcttgaattcctgacctcgtgatccacccgcctcggcctcccaaaatgctgggattacaagtgtgagccactgcccccggcccctgttgtacctctttttaaattgtaaatttcatctttaactcatttctttcttctcaactcctactgtatatggttaaaaatagccacacagctcctttgatattttgcttagaaatttcttctaccaaatatcctagttcattagttcattgctcttaaatcctgccctaggtcatgcacacaattcagccacattatttgccacttcataacaaggatggtgtttactccagtttacaataagatatttatcttttttatctgagacctcatcagaatggcctttatgtccatgtttataccaacattctgatcatgaccccttaagtaatccctaagaggcctcagactttccccatagcacgtctcttcttccgagccctcatcagaatcatccttaatactccatttatggcaatctaggctttttctaatctgctcttccaggttcttccagcccctacccattacccagttccacattttcagttattttttatagtaacaatcctactctcggtaccacttctctgtctttcttcattttgtgttgctataatagaataccacacatggagtaatttataaataaaagaaattcatttctaacaattctggagggtaggaagtcaaaggttgagggctcggcttctgttgagaaccttcttgctgcatcatcccatggtggaaggcagaagggcaaaagagggcaagagcaagtgagcaagagagggccgaacttgctttcataacaatccactctcatgataaccaacccacttctgcaattatgacattaatccattaatgggggcagagccctcatggcctaattatctcttaagggttccggtcctatctcttaataccatcacagtggcatttaaattttaacatgagttttggaggggacattcaaaccatagcagaggtttaagtaagataaagactgagaactattcattgcatttggcaagttagagttatgggagtgtgggtctatggaccagcctacagagagagggctgaaagagtgaagaggaggtgaggaagtagagatggtatattcttttgaggaacatggtcatttattcaatggttatttattgagctcctaccatgtgtcaggccttgctctagatgttaatggcatgtcagtgaataaaacaaacacatttctgccctgaagaataccactttacattgggcctatagagggaaggggagaagaggctagaaatagggtacatagtcaaggaaatcgtggagttttttttaaaggaaaataagtatttaaatatatttaagttaaggaaacatgggtagatacaaagtagagatgaagtggttgacagtataggaaagacaggataattattggtcaaaaaatatggggagatagagatcaaaacataggtagaggctctttgtgagtcttgaatgggagaagagatactttattctttctcaaactggaaggaaagagctgatgtgcacacagtgtgagggaatgcttcctagatgaccctgattttctaagggatgtaggagcaaggtcacccatatagagaggattgtgataggggacttgagagtcatgaagctttgaaatgagcatttagggtaagtggagagtcagatgaaggaagacaagtggaggtttgtggagtagcactgaagaatttgtaatgacattaattttttatcagtgtggttttaccaaaactgttctcagcctcctacatgcaggaatgaagaaagcagtttgcgagattggtcctggatttagagctttgtaggtaagtcatttatggcaaaaagccaggttgggaaggaattgagagggctagtgagagaataggttccatgaatcaatatggtgttcagagatcagagggaaagtgtagatgaggactggtaagggctttgagaaactgagggtagagtcaaaagagtagtggtctttagctgagtgcagtgctacatgcctgtaggcccagctactcaggaggctgaaatgggaagatcacttgagcccaggtgttcaaggctgcattgcacatgattatgcctgtgaatagccactgcactccaacctgggcaacatagtgagacccctgtctcttaaaaaaaaaaaacaaaaaagagagtagaggtcttaaagagctatgtagtagaagttatggagctgaaaaatgagagagggctattatgtgtcagggatgaagtaatatgtgataacagatcctactctctcactatagaagaggtaggtaaaaaagagtggaggtgaagatccttaaagcaaaggagttttgggactcagcaatctaggtttctggattggggtgggtgttgcatgtggatgatagaattttcaagtaccatggcaagtgttggcatagagaacaagtttgaaagccaaatttcaaactcttcagccaatgggcaataagtgaccagagaccggtgtttgatagtgatgacaacggatggtaaaggtcactacagataagaagtctgagaactataagatggtgtgttcagatttcatcagatgatggcaggagatgagatggagaggccaccagtgacccaaatgaatgaaggcacacgtccaaggagatggatagatgaccatgatgaggatgggtaaaagctggtatctccagatgatatcaaactaaaggaatgatgccatgagtatggagtaatagactctataagcaagggggaggcaagaggaagcttgcttattgccctctgagttacatagttaagaggttcacagggggaagaattttaagaagacagccaagtttcaaggaatgtgggtggttgtaaggtagggtttctgatgttaagatatagagagtttgattaacaaggatggcaggttctataggacgtagttttttttttttttttgagataggttcttgctctgatttccaatctagaatgcagtggcacaatcatagctcactgcaacgtcaacctcctaggctcagatgatcatcctgcctcagcctctggaataactgggattacaggcgtgagccaccacatccagctaattttttgattttttttgtagagatgaggtctcactgtgttgcccaggctggtctcgaactcctgggctcaagcagagtcctcccacctcggcttcccaaagtgctgggattataggtgtaagcccctgcacccagccatataggacatagctagtttgtttgtttgttgatgagacagggtctcactctgttgcccaagctggagtgcagtggcgtgatcttgactcactgcaatctctgcctcccagggtcaactgatcctcctgcctcaatctcccgagtagcttggactacaggcatgcacgccaccatgcccaggtaattgttttgtatttgtagagaagttttactatgttgcccaggcttgtctcgaactcctgagctcaagcaatctgcttgtctgggcctcccaaagtgttgggattacaggtgtgagccactgcgcctggcccaggacttagtttaatgaatgggagagagagagggaagggaaacaattaggtcatgtatgtggagtggaagaaggaagcccagagcagtaagtagatcaggataggcaattggatgagagtcatgggtagatgtaattggccttttgagtcccacaatttttttttttttttgtacaggcattttcagtaaatgccatgtaagcagtgcagagtgccacaggagtcactggtcagtcgcttccaccaaccgtttccttttgcagatactgcctgggtctgaacctgattaaagttctacattataggcttcctactccaaatcctaatgtttattctaactagtatcagtctgtttcagtcaaaatacaaactataacaatgaacacgctattttagaaatgtagccaaaatccttacttatgatctatgattatgtttcttttaaattttaaatgtattcctaggagtgaacgaaagcgtttcttcatagtgttttatggtcaccattagagcccaaatcctgctttccctatagcaactgggtggttgtgtttttattaatctattaatttattttaaaaaagaaaaaatagcagcaaaagtaaagtaaaccttaggagttacacaatggattgcatacttaatgctatggacaattgctaacccaaccttactttaacatttacaaagccagttttgattagctctttattcctagttatcagatatactccatttctctaaattaagtccagaggtggtccttactgagatttatagccactgataccacaaagtcttataatttagctgtttaagaattcttttgggtaaaaataatttaggaaggaaatctagtgttcaccaggttggaaacaactggacattagtaaaattgaagctccttagcaaagcttattccggtttgttatataacataccgattaatagccagaggttacctggattcatacaagaggcactgtttctcaaggtcaagcattgcatggccctttattgcaacttttcttttaaatatgaacgtataagtcagacttatttttggatgatcatagtgaaacccgaagatccataatgaagtttatgtgacagagatccccacacaacaatctgagcgatctctatagtggtgtacaacttccctgttgctttggcagtttcttaaacgtaattattcccaaagcaaatctattcaagcatatttaaaaagaatgggacagtatttggcaagcataagcgtgttttaaaagtgattccaaagatttaaaggttttagctgtaagaatgatggataatgagaattgcagaaaattagcgagagttcttttgccaagaacagtagtttgggaaagctttgggctttaaatagagggaattatgaataaagacagtagttgataaagatgaatacagtaaaaattaaagtgttgttgcctttaagagtattttatgtataaacttgattgatgtaaacttaattgttcaatgtttaaaagctctaattaatgtagtttatacttagtatgaagcacatcaaggtctccatttcctctactcactggaataattgaactatatattcagacttctctcactgcttcactccctacatatattcccctttacttttctctcaaaaatccctgacttctcctgataaaaataaattgctttaaacatttattgttaataaatgcattaatgaaaaagcagaaacatttgtggtggtttctctagttttttaaagcaaatctctgtaggggttcctaatttagttctgttccacgttgccctctggtcactaaatcaaacacagagccactgctgcttagggagctggcattctagtaaggcaagctagtgctagggcactagctggaagcctgttttgagctgactggaggctatgaaccccctaaagaaagagacagggtcccttgggcctgaggcttatcggtgatgggaggaaatgttgggtccagcccctggggaggtgaggtgcactagagaaactgagaggcaaacaagtgtgtccaccaggacctaatgttgctcacaaccccttaaccacttaatcatctgtcattcttttaagtaaatacctgcttatgctcattttatcgttttgaacattccatcttcagggtgctaacttgacaaatttttggtaaatctgtgcaatattagataaccacaggaacctttttattcaactcccacactttatgaatgggaaaacagactcagagagggggaactgagatagagttggctttctggtaagataagcttcctaatttagcatggggattatgcttatcactgtgtctagctcattccatgttctttaaatatttgtttcaataaaatgggataggcctttggattaggggatctcacaaatacacaggcccctacacacacacagattattgatttgatttggaaagaatgataggagaaggtgaatgtctgaggccaaccatttgcaattctaaatctgtggcccccttcttgttcagagctgttagctgctctgaccatcttctcctctttagttagggtgctaccagggcagtatggaaggtttcttcccactgcttgccctgcatatgtgctttcttcttactcggcaccaggcctttcctgcattgcaggtattgcagggccacgtggtatgacacagttgggtgaatttgattacacatgctgtttatttttgcttccagtctagtgcttacccagagccctccactctctgctactccttgcattcaaccctaaactgagtcatttatcataacctttgctgaaccttttgaagctgatttttctttcctttttgcaagcattttgttttattgaagtcttgaatgaagtcacaatgtactattctgtcttttgttcatatgctaattaagaagtgttatctagttagcgtggcatagttcatttacaaaactattcatggtcattttgattttataaggtttctctctgtttctgtttcgcaaagactgtatatatgttttttagttaaacaaagttaatgttaatttctttcatttgtgctccctgagtttcaagtgtaataaccctgcagatatatttcacctatttgtattagaattatatttttttccatggacatcagttttttttttttttctttgtcagaagcaactagttattggcagcaaaggaatttattattccattgtgctatataacacaactaacaattttttttcagtatttacaatatgaaggcactgtttcataattgctttataagttgtcatcaacataatcaccccctttgagactggtgggaaaactgagacatcacatggttaaggagcttgccccaggttacataactaataagtggcagaaccaatatttgaacccagatatctggctgtagaactgatacacatagccagtatgcttctgttcttcatcatcccttgtacaggctctttgaaacaacctggtaattgccatgctctatgaaaaaaggccattaaaattgcaaatattggagtacctctgatttttgagcatcaaaaatatacccatcagaagatattcatgagacagttaaacattgaggctccaaccttgtttatactatattttcatctctggtcatacataacttgatgacccttggtgatctcaaatgactctaaatgatactctgattttggggctaggcctgtttaatcaaatgagtgagccatatctgtttgtaattcttccatccatccatctttccatctgtccatctatagaattcttcatctgcacgtaacagacacttaggtgttacttatccttactgcagaagaagtcctgttgtatcctaagagaataagacacagcttcaagaatcactggctgatcaccttgaggggaagccagtttgtaagggttcgccaattttatgtatctgcagccttccatatgttacagggactcttaattaagctgctgaatttggcattagttgaactttcagtttactttcaaggagagtcatgcagacaattccagtccaagagaacagcagttgggaataaactgagatacttggcgagaaaatgaggtgggagttgaatttgatgacagcagagcattcttgctggagactactagtggaaaatgaagttagaatggcaagggaaagtaaggtttgttagagtagctctgaaaccaagcacagtatacaactgaaaataaaattctcttgtcattgtatgcagactctagctttggagcctggcacgtgtgaattatacaaagattttcaaactaatttgatcgtattctagatcacaagaggccaaaattacccaacgctcagacacattaatctcttggaaatttaagacaaactctacgcagccccagtcagcctctacatttcagcaactcttattcctttcttctgtatttacttagcagtgcgctgcaaatatacttgtatacttccttcacttatgtcctacttgtgtttcctgtcaactctatgagattgtaaacttgcctattgcaggaattgatacagccctagctcagaggtcagtgagaggtagaatgcaagcaaaaggagagaagtgattgggcttcgcctcagcctgtacctactacccagctgatacttttcacaatggcaaaaggtgaaagagtggaagaaaagggggagagttactctatggcacatggcaggaggaagattggtacccttggagggcatgtatggaatttaaaacctgctcactttgggaggctgaggtgggcagatcatgaggtcaggagatcgagaccatcctggctaacacggtgaaaccctgcctctactaaaaatacaaacaaattaggtgcgtgtggtggcgggtgcctgtagtcccagctacttgggaggctgaggcaggagaatggcgtgagcctggaaggcggagcttgcagtgagccgagattgcaccactgcactccagcctgggcgacagaaggagactgtctcaaaaaagcaaaacaaaacaaaacaaaaaaacctgctcatgcattctgggcagggcaatgcaaggcaagataagtggagccttggatagcaatgggcctgtctttgagttataacctgataaggtcctagtcccaggaaaatagctaggggaacgaggaagaaataactttccttagggaaatcacttaaaaaaatcaccttactaggttccattgtttctgagctccagagcaagatggagtgtgtatatatgtgtatgtatgtataatgttttaaaaactttattgtttattgccttttccatcccaaggtaccagaaaatttcataagtggcaatttttgtgattgaaatataccacttaggtgttctagttgttcttctacacaagattcactgtagtctcagcatggggatggcaaaagctgataggagaaaattttctctcttgtcttttgaacatcaatgaaaggagagttttccttacctctctgcagctcttgaatgttgaattttaatattctcatttggagtttcatttgaacaaatagctttcttctccaagcccttgtaccaccaatcatttcaacctgcagttctccttctctactccacctcaccctttgtagaaacaattctttggtcttagaaaggtttagacacagttcattaactagtattttgtatttataaaaattcaagtgtgtggatgaaaactactgaaacaagtcttgttgtctaattgtagtagagtatctaggtttagagttgattgcccagtagtgttgtagagactatgacccaacaaatagtgccgttgattacatgctgttatttactcatttattagtgagcactttgtgtgggcttcattactaattgttatgtcaaatatctgtataaataaataatatctgttaatcattgagatgttattctttaaaatgtaattttcagtttgtaaaaagtgcaaagataatgttatatcacaccagtgtcctttgacggctttggcagagtctttaaaaaaattttttttatttccatagatttttggggaacaagtggtatttggttacatgagtaagttctttagtgtgatttgtgagattttggtgcacccatcacccgagcagtatacactgaacccaatttgtagtcttttatccctcacccccttcccacccttcagtcttttttttttgtatgagactttatataggttagtgatatttctccctgctctgcttgcagagaaatcaatgctgtgaaaaataccctgccccagtttatgattattaagtgagataaacttaaaaagagaacagctcatgactggctgatttgaatgtttgtcttatgcccagcctctgttccatggtacacactagtgccagatgataggcccttctgaaaaccttttacaattgtccttgtattttatggcaggatatgttcacagaaaattttctgtaagtcaaaataatgtaaattgaatctgattttcttcacagaaacaatattacattggggattatatctctggcctaaagcctgactttttataaaaatagaaatagctgtaaccatcattttaatcaactgtttaatcagctggaaatgatgaatctgaatactgttcaggagaaaattgtctgaagtatgtttaaaatcagttaacaaggcatcacaacaaccagtcacattaaattatgtttaatgaactaaagtgtcgtagtagactatacaaagtttttgtcataatcactgccttgtttttactgaaactaattagaaggtggtttttcttaaagcagtttctgcaaagtcaaggacttctcacaggatttcttttagtaaattttgataggtatgcttgaggagacttttgggggagactttgaagagacttggtgtttcggctttttgagaaactgaattgagattttcttcatgctttgctttgctcattgtaaattccctgtagcagacatagattttggagaacaaattgttggtctgtcttcattttgattgtcaccagagaagggttaatgataaaattatggttgttgagatctgaaggattattatcagcaggtaaagagggaagagtattctatgccgagggaaacagtggaatactcagggacaagaagggtcctccggcttacctggaatggaaaaaaggccaatgggttataatagagaaagagaagaggagggcaaatgaagttgaggaaataggaggaagagaccagactgtgtataaaactttgcaggtcagaataaggattttaattttcagttctaagatcaatgggaaacgattcaagtggggcctggaggagcaatatggttaggtttgtgttgcacatggttgttgtgtggtcctagctaggttagccctcagggtactgtgcagccatcattcttggcacttagctgagttgtatgagcatttgatgaatgcccggtctcccctctccctatactctaagctccttgaaggcaaggactatgtcttttttactcatcaccctgtctctagtgctgtacacatagtaggagctcaataaatattggttgaatggatgcatcaactgtgttaacggatttaccttgtgacccactattaggcaagggagttacttttttattgaggtgaaattcacataacataaaactaaccattgtaaagtgaacaatctattggaatttagtacatttatattttttataaccacaaactcgtacctagttccggaacatttttatctccttaaaaggaaactccatacttattaaacagttactctgcattctcccctccccctagcacctggtaactaccaatctgctttctgtttttatggattaacctattctgcatatttcatatgatggaattatgcattatgtgaccttttgtgtctggcttctttcacttggcataatgtttttgagattcattcacattgtggaacatatcaatgcttcattcatttttatggctgaataatatttcattgtatggatataccacattgtgtttatccattcatcagttatggacatttgggttgtttccaccttttttttttttgagacagaatcttgctctgttgccctggctggagtgcagtggtgtgatctcagctcaatgtaatctctgcctcctgggttcaagcgattttcctgcctcagcctcccaagtagctgggattacaggcatctgccaccacgcctggataatttttgtatttttagtagagacagggtttcaccatgttggccatgctggctcgaactactgacctcaggtgatccgcccaccttggcctcccaaagtaccgtgattacaggcatgagccactgcaccagactgtttccaccttttgaatagttctgctatgatcatgcatgcacaagtttttgttctgatacctgttttcaattcttttgggcctatgcttaggagtggaattgtggggtcatatggtaattctatgtttaactttttaatgaactgccaaactgtttctcataggagctgaatcattttacagtcccaccagcaatgtatgagggttccaattactccacatccttgtcaacacttgttattttctttttttttttcttacaggctgttcattcacgccatctggaatgcatgaatgaacttccccttatttgcagtgaatatttcattccttggtactttattacatggttatttcacagtatgaaaatagaagtaaaactcaaaggtatattggacagaattggattctaaattcataaaatttgagtccaacagcattctggtacattgctttctgagatagacctgcaactattaggagaaccccagtttttctcttatatactatttttaggattgaagaagcagtctaaaggactaatctcacatccaaagaagtttcttccttctgaacatatgtattggttaaatcatttaacaactcttctattggaggtgtcttttgagagttgcattgagaattatgaggaagccccatgtagtcttatagctgaacgttctcatcataggcaattttctattggtttgacacatttgtatttctacccttctcctttttgtttttgttttgttttagtttagctgtgctcagcatgcagggaatagttgtatttgcttatagtaaatgactgggaaccaagctgagatgtcagcagaacattgtagaatactcaagtacactgactatataaagatcattcagattcctgtccatctgaagtaatcagactatcagtccaccattaatttgaggtctatcagtcctcattaataatgctaccaatgcaaatgcactttaattccattctttgaggactgcctatatttcattgggttctgccatttttcttcccttaagtaatgctataactattttctatttgacagcatgtagaacattttacatcatatccgagtttacaaagtagagtaagaatagacttagaattgtattaacatgttgcatacacatgtgctttttataataatgcaaactggagtgaaatgcattgcagtcaggagaattgagtctttatgaacttttaatttttgagtactagtcataactaagctgcttgcattccactgagcaaaggtttcctaatgaagaaacctacaactactgtgttgtttcatgatttagctgaaagtattattttctgtttaaagcttcctaggcattttttaatgttggctgtaaattcttataatggttctagataccccctatgtgtgctttagaaataccccattgctattttcagtcatacacttgaatagaacttctaactactgtttgtcttatttggtaaaaaacatttgttttgtggaaaattgtttggtttgagggtggtttggcctttagtgtgagtggtgtttttgtgaagtcatgcgttttgaatgtatccactctaataaaaattatttcaaatggctttatctctcctccctgtccctgtgtgtgtgtgtgtgtatgtgtgtgtgtgttttcattttacagcagaaatcctgtgtataggtaagatttgtattctaagaggtttattaattttaaaaattgccctcatggtagttaattctaacctgatttacttgcagttgtttgtaccttggttgctgggaaatggatttcattctgttttatcagaggagtaaacaatttccctagggtaataggcacatttgagaaggcattcattttttcacatttaaagattaccattaagtaaattgctactgtggtgctttaagtgggcatcttaaaagcctgaaagaaccaatgtaccctctagtgtaccaaaattagcaccttgaaggagttttatctagtcagtttgtacttaaacattttttttaaaggcattagcacatgaacctttccctggactttgtgacttttcatgaggttttatttatttttccctccttttctgctttgaagcctgaaattgtttttgtttgtttttgttttggagagagtctcgttctgtcacccaggctggagtgcaatggtgcgatctcggctcactgcaacctccggctcccaggctcaagcgattctcctgcctcatcctcctgagtagctgggattacaggcacctgtgaccactcctggctaatttttgtatttttagtagaggcaggttttgccatgttggccaatctggtctcgaactcctgacctcaggtgatctgcccacctcggcctcccaaagtgctgagattacaggcatgagccaccgtgcccggcccaaacctgcaattttttattccacatatattgtcttctcgtgtgtattagtttgtaagttactctttatcctgaaacagggagtaatttcttcctcacccttgaatgctttttttttgttttaggggactaggctgaaacaggtggcaagtgatgcaacatccaaagccacttttcaagctttttttttttttttttttttttttttgagatggagtctcgctctgtcacccaggctggaatgcagtgatgcgatctcagctcactgcaacctccgcctcccgggttcaagtgattctcctgcctcagcctcccaagtagttggaattacaggtgtgtaccaccacgcctggctaatttttgtgtttttagtagagacggagttttgccatgttggccaggctagtctcaaactcctgaccaagtgatccacccacctcggcttcccaaagtgctaggattataggtgtgagccaccacactcggccggccacatttcaagttttattgctagaaagtccgtccccactagctgggtgcggtggctcacggctgtaatcccagcactttgggaggccgaggcgggtggatcacctgaggtcaggagttcgagaccagcctggccaacatggcgaaaacccgtctttactaaaaatacaaaaattagctgggtgtggtagtgggcgcctgtaatcccagctattcaggaggctgaggcaggagaactgcttgaacccaggaggcggaggttgcagtgagccgagatcacaccattgcagtccagcctgggtgacaagagcgaaactccgtgtcaaagaaaatctggccccactttcccctgcttcattttagatcagattatttagtcaagtcctctccaagttacatatgaagaaaccaatgccaggacttccccaagacacatacagaccgattgatggtagaaggctattaggaccttgatctcctggtttcttgcctctctttattaagctttagaagcaaaaacacccacctgggatcatagccaaatacttaattttatcaatttttggcatacatggatagaaattgtcacaaatacaacactgatctcacctcataaccttgagtgctttgccagtatagctgattgtgaataccatgtgttttttctaccagtggactctagcatagatgtagcccagatatgtagacatgtttgctgagataagaggtatattacagtagcattgcccaaaacatgttgtacagaatgtgatgtcactggattttccttgtgggaagaaaagagttctgtggtcaaaaaattttgggaaatgctgacttacacaaagttaaaagaggtttcttcaagactttatggagcttttactacatgggtatgcattgtgaataaccaggaggaggggtgggcttcccctttctctaaggaacctcattattaacttgttccatgtaattcagtctggggaacattgagtgtggtgtcctgatattcttgccatttatcttactgtggcattcctagttggcagtactcaaaggcacattaaaatttaacaatctaaacaatttttatttatatgtaaggcattactgaatatttgtcgtgctcttctttttatgcttcaatatccaagttatacattacatttcaaacgtcttgctaatttatatagtctcttttaagcatgttttaggaataattacaatcagatcatcagttatatttatagcagcatccagtctttatagtgcacagaagcttcaaatccaaagctttggggagagggaagagatgatggagagacagtgtcaataattccagtgcagttcccaagtgcctgtgtactctgccacaaagggagaaacgaattcctatttttactgtcaggatgtcagatcaacagttccaaaatactaacggtatatgttctggacagcagcctccataagctcctccagtggccctcagttgtcatcaaacatggcacttgtcaagctccctggctaactctagtcctcttcatgaacactgaagaacagtgttttcaaaaccaagcactctctgctagtggaccataattcatcctgcccctttaggcaggggtagcaccaaaatttcccgtgcctcttctgtagagccagaaactttcttgctttaaataaaacatttacatgtgggttatgttgaggacgttgcctagttccatgctggcccagttgctagagtttcaatattcctatagtttgttaacatctgcaaacctcatcctttgttcctgcgaatagtttacagtcatttaaagtgatttctgggtgtttctgttaatcctgctgtaagcagtctcttacgttatgtgaccttattttatagataaggaaatgaggctcaactaagccattttctccaggtctcattttgaagaaaaaaaaaatgtaaataatatttctcagagtcataactgtcttgctttccctgtcctctccagattttgccctgaaagccttccctgtaggaagaatgtttgtttttttttaaagagatggggtctttactctgttgcccaagctggagtgcagtggtgatcatagttcactgtaacctcgaacttctgggcttaagtggtcctcctgcctcaggttccctagtaggtaggactacaggtgtgtgccagcatgccccgctaattaaaaaaaatttttttttcgtagagacaggggtctcactatgtttgaccaggctggtctggaactctgggcctcaagcaaagcattgggattacaggtccaagccactgtgccaggtccaggaagaatgcgccccccgccccgaaaccctttactttcttcatttattcaactaagccatgctccacaatggaaacttgctttttatctacctcttttgttggggatgttaagaaaagttatagcctggatgtgctctttaaattaattacatttacagctcgggcagtttttaagccagtttgctttttgtatggtatttaacagtttacttggaaaaatgcattcattggttttgctggacacactccaacttgtatttgaactggcagacctttctaggaaacatcacttttatagtaatgacactatcactgaaaaaagaaataaaaccctgttcaggtcgtcagacaccagttttacaatattttttcttttgctccagctagagtttcttatctcttcttaaactgtaataaaaattcttctgtggtgatctagaaagtaatttttggatgagaatttatctcttctaggtaatgatgctggtcaaggcatttttctccctaatatccactggcttttttccttgcgattgctagatattactgttggctgctgagatataactttcttacctctgagatatctaaatagtgagaaaagtcttccatccctaagggacctttccacataaaccatctgcttaggcctttgttgcatatatttttgaagcttgaatttactgtattacagtgactcttagggtggagaaactgtatcatagtgaatacttagattatgtctcttcctcttaaactacaactaaaagttcaattcaactttcctccgaagcttattgtttagccccactttttattgtggtccatttattgtaggcagggattagaaaagaacttcccaagatgaggaaaaattactgtgtggtgtaagatactgatatttaaaataataacaccttaaaatacagaagttacaaaggcaaatcaggtctttggagaagaataacaaaaagatatgaaatggtgcaataatggggctaaggccgccagagtactgctttgagctcttaaggaatagactgtcatctgatgcttcctttgctgcctcccatggaagtacaggaactaggcaagccataattggctcacttcccaagttctgggaaactttacaaggatcacaggggttggtacaagttgcttgataatctgcagcattctctctgagatttagctgccattgtgttgccaaatttctgcatgtcagtatgcagatggtcccatctctccctccagcctctgaggtttgtaatctatatttatttctcctcttttcagccaggttgggttttgaggtcttggggcctgctttattcctgctttttatttgcatgtatatttttatccatttcctgagggtaatcgtaaatggttagctggattttcagcctcactgctcctatctttaagagttaagaatctccttatttagagttttaaattttgttaagtgtttggaatgaaaggctgtgtgtagagatgggtagggtgaaagtgaaagggaacttctgaggttttgtatacttgctggttaagtttctgtgcatattgtcaggctttgggttaggaaagattctgttaataagggaagttgagttgctgagaccccaaaggaacactgagagtcgcaggttacttcctataaatggaagaacctgaatcattaaaagataaaattcctgttagaatcttgaatcacagaatgtttacagtatttttgatccatcaactttctattagcaatcctttaatgaagctgcatttcagtctttagagccacaatttctgagccctgaagttcttggagtaagggcatggtgggggaagggggatcagattgggaatacttagaattgattgtccctggtgaaattaaactgctcagtggatcactttgagataatgaaaggtccactctgagcttccaaacaaggcattgttcttatccaaatcctcatggtcagtctttttcttaagtgttgtgcttgctgatttaggtgtttgtgtgaggcttaatatccatttcctgtagtagtttttttttttcaattaaatgtgaagccattgggtaatgcctaattagagaaatctttgtgtttagggataaactttatgtattcatttgtcctttggtcaggtgtttgagaatttcagttaatatgactgtaattaagctttaaaggcagaacaacacaaaatgccccatcagtcttgcttcacttcctttggcaaaaggagagacagcttaatcacttcagaagttgcagtaaaagcaaaatctgaaaagtgcaattttaaggatcattttagagttatgattgtaaattacacattaagtttattcatttttgcttgttataatggagtgggcttggaaacctcagcaatttgaccaccgaatacattgtagttattttaaccaagaagcttaatacactggaaatgtttcctggcactgtagtgatctcctccccatacccccaccccttcagccctagtatggaaatgctgacttctgggagcattttagtagacatctgaaattttgatgaaatgctctttcaattttgaatttggcctttttaagacactatgctgttcaaaaatattcctgcttcagagaagaaaatagctttgggctggagagtggagaaccattttaaatcattgccaagtcttcagattttaataagaaatttttttgttcatttttgagcaaatacttttatttgctgtggttgcttacagaaagcagttcgatgaccaataaaagtaatgctgtaactgccagggattacgtcggttttaagattatttgctgataatccaagtagctttgcattatatcagggcctgtaattctcattatcagtgatctgaataattgatgggagataaccacatgcaaaataaattgtcgaaggggaatcttactttgcgagcagcttaaaatggttggacggaacactgagggttatttgtatttttaacctttggaaagcaaattgtttaaattatttaaagaaatagtgcaagattatggctggcatactaaaaacttgcaggatgttatttaaggacgatcactgtttgaaagagtctgtggcagtaattcttagctgtgcttgcaaattagaattgtcacctggggagcttccagaaaaattaaatattaaataaaagaaccaggcatcagtattgtgtttaaatccactgtgtgaccaggattaagagtcaaagatctatggctaactcataaatataagtttgccagcaaatggaaaggatatagaggtaggctttatttcagatccttttgccagcttttatagtaacagtcttgtattgaggtctctgtttttcttcagttcttatctagtcaggtctggaggcaaccaaggaacaaattttatttccaatggcttttcatttttttatgactagcaaagacataggattttaagatggtgccagttaaataattactgtgttaggttttttattgagaggccattttggggtataaattacttgctttatttttttttacagcattcagtttatactatggaggtataaattaggagtacaaaaggttgatttttatcttgagaaagaaatttacattgctttctctgttaattcatatattgtaaacatattttttaatatttgccatactttattatgtagtgtgatgtgtcattaaaatagagtcagtaccagcatatttccagttttaagaaatgctgttcttaaggacaattgaatgggaagcagttcagcacaggatggactcctaatgaattacaattcattacgaggtgccaggaatcacacactcccactccagactacactgcgtgccatccaaatgggaattttaaaaatgatttctacttagcgtttctctgctttggcaaagacacctacattattcaaaatcacaggaactaacaccactgtttttaacactctatattggcagcaggtgggcaattacattgaatttacttgagttcagcattgctattttttatgtgaaccaaatattattatacagttgcaggaaattccaccagccattgcagtttcatcagcttttagggtgaaacaggcacggaaaagacacctacttcatactaccccacccccagtctcaggcacgtctcaacccaaacctgtttagggtaaagagactgtaaaatgctattttggaaaatgctcaggagtggacattctgctgcttctttcaggcttctgtttcatcatctaacagcaatcactgccgggatgtgcacacacaaaaccccaaacctgcatagtaatttcaatccattttctccaatttaatggagatagaggccacttaggccttattcagaaaagatcagagagatagtgtatgaggaaagctcttagtgaaactggaaatgtcattcaaatgtagggaattaataaaaatatcagtgtgcctaaaaaaattgtattgtgctttttccttttgttctttggcatggaatgtagaagacaattcagaattgggaaagcactagtccatttctgttttaagttaatcagtggttgctgtaattgaggggaaaaatctatattgacagcacatgacatatcctacttcactgattctctacctcctttgcctcttccccctttccacttgtagaattaactaagaacttgtataaaaggtaaccctgcctcatttactctgcagccacttcttccttgtgtgaaaaactaaacagccatatgaatattaaattaaaggttgcaaattgcaatgtatacgtggacttggcattttctgtaattcaaattggtacattataagagtcaggtctgttgtggagaccacagagaggccttaacctgcaacagaaggtgggagctggggtgaagccagataaactatacatctggcaggtgcacacactttcacttttaagttttacaaaatggatattatggaaaatttggtgctcttatcagtaagctgtgtcagaacctgtatattacagttgcaaacagagaagtaagcccctaaatcaaagctaccacttggtaaaggtactgtttactggtttccaggaactgtgtgaaaatttatctatgaatcatttactcttagcatgcgaaggaccttggacaatcagttgttctaatgccttgtctttgggcaggcagataaataactaagctatccagcatagatacttaactgactttttccaggtctccagggatcccacaaattctcttagcacatgccagagtagctttccagagttatatacagcctgaatctcttctacttcagtttgtcccagttactttttgcatgattccctacaaattttgaaggcaatatcataagcttaaatgaaaacgcaaggcaaagaggttttatctgtacttggggggtgatttttaatttttaaacgaagaaataattttccacataccatctacataagatgcacaaattcagactggagtactttcagacattgtagataattggaagactacaagttctaagtagtcttgcttaaaatgattactttgagggtgggatttatacctttgacctttaaatagatcactgaaaggaaggaaaatctttgtgactacatatattaaaacattttaggttggggaattatagttctaaaaaataatgggaatatataaatgggtatttgtttctgtcatgcatcctttgacttatatatgtggtagtctcagatatggtaatatagtaccatacaaggagactgtcccaaatttatataagaaaagggtattatcctgattaaagtgaagagagtgaggccttagcaaaattaaagggtgggataaaatagagcccaatcttgaaacttttaggttcggtgagtctacttattaaaaatgtaaaaggggcatgagaaatatattgtgtgaattggaactttacaacaatgaggctctgagagattgcaaaataaactatcctgtaaagccaaataactagtttctttttagaaaaagtcgatcatttcttcaatagaggcagccattctatttctgacctttacacttatacacaattattttgtgtttagaagtaatctgcattatgctttctgttctctagtaaggtagttgaaaggttgtcctcagtagttgcataataaatgaaatattcccagtccattctttcgtgagttagtgtgttgctagtgaaggttatggttaagattcatttgggctgtggatgaaagaaaaatgattggcagtaaaaatattgtttctctagggtactttctttaatcattttagaattgcactgttgacctcagaacagttggttcaaacagcacttttactaatctttactatgtcagcaagtaagagcttaatggattttgaattccctaacaaggttttctcctctccctactactttctcgccagattatggcccagcatgcttggacaagaattatgggcttggtagaagtgtggacaaatgtgatgaaaaactgaattttttcccttttctcttggtcagtgtgctggagaagagaaacgagttggcacacgcacagtgtttgttggcaatcatccagtttcggaaacagaagcttacattgcacaaagattttgtgataatagaatagtctcatctaaggtaagtttttgttttaactcaatagatgttcatatagtgaatcagataatgcattctaatttgtgcttctgaggaaactgatgcatttatgtatgtgtacatgtatttgcatgtatatggatcatataccagctataataagtattcctctgaaagacagtttatttaaaaaatcactttgtcttgttataggtgaaagatcattcacttgccttccgttatgattcacagtgcttgttgattatgcatattactttaaaccgtaaagtttgctaaaaatacaaattacttacttgtgcaaagcttcctgaattacccttgaatggatgaactaggatataaaagaatgcaaattcttttataaaagaatttgcattcttttggagaatgctgtcctggaatgactttatttgcatttctttctagttcccctgccaacccctccacctcccatcccacttctcaagtattaatagactcctacgtcccaaagggtgcatgctgctcagtacactgcttcagctgtgatctgttaagagttaagtcactgcagctgtgtcaccgtttgactgcatctttcttcagcatagtgtaggactaagagcattggcctggaagtttgaacacctgtatttaaatcctggcccaaccacttactagttgtgtcaccttggtcaaattaatcgccccgattctaaatgtcctcgttggtgaaatggggctaatactctgtgaaaccacttcttatagctcctagtactcagtagtcatcattctgcaagtgttatttagctagtctttacctctggctgaccaggttaggtgctaggttggcctactgccatctcttatagaatggaatagatcttgaagattttcctcacttcctcatgtgccctggcaaggcagagataaaagttggtgacatttggttcactgtacacttgtaatcacttagaaactgaaacacaaaattatgcccttccttaaaaatatatgacattttggttttcaaatatgcatttaatttcttgtttgggcggtgatacagtagtgatcatgttttgctgggagattaacatgtgaaatatggtcaggacaggtgaaaattttgttgcctaatgagcagatatgtaggcctatagaacattttattttggataaaaatgtctatttcctcttaatcttacacactagtggcagaaattttattctcagccagaggttgacatacttatgcctaaaatagtgaatagttcttttactggaaatttcagctcaccttgtggtatccaattaaatggtctgtagtagtcctttgattcagaattgtggacttgtagagctaaatggtcttaagaggttaaggccagagaaatttaggcacatggtcaccaagcagagttagtaataaaaccaggagtagaactactttataaggtctagttgctctgaataaagaggtctttttacatcatcgtgctgtttgggttccttcctcattttttttctctcctcttgcattgtgcttggcatggggcgacaactcaaacggtagctgctattgttatttgtgtttctgtgattattattacaatagtgagtagtactattgatttcctcaagttcatgtgttttgaatgtgtgggatactgtctcctaaatggaggccttcaggtctactccgaaaagaccaacaatttcataatttgactttttcttcctcacattgtcttggctgtttgtatttataccagaattttttaaaggattattttttcaaaatatactgtttatagaatatgttagctgccttccaactttgtagcaagtgttgattttctttctccacccttcagtcataaaaataactatcttaattggatgccgcttttgtttacaaataccaccagtaatgtgacattataaatgttaaggcagggaacactgaagacaaacattttgacctactttaagttttatttgcttataaaagtaatgctttttttgtgggggggagacagagtctcgctctgtcgtccaggctggagttcagtggcgcgatcttggctcactgcaagccccgcctcctgggttcacgccattctcctgcctcagcctcccaagtagctgggactacaggcgcccaccaccacgcccggctaattttttgtatttttagtagagatggggtttcactgggttagccaggatggtctcgtgatccgcctgccttggccttccaaagtgctgggattacaggcgtgaaccactgcacccggcctaatgctttttgtttttttatctcctgggaacacaaatactttctttagaaaaatttggcctctacagcctcacaaactttaatgtactctgcagggattttggaaatcaccagaattttgtagctggtgcaaaacttggaaattcccttctttagcaaaaggagcattgattgtactctgctatgaattttaggatctttagtttccatcatgtttatctgttgtgtgtttttttcctttaaaaattttaaaggttttttttaaaaaattaattaatttttttttttttttttttggtatttttagtagagacggggtttcaccatattggccaggctggtcacaaactcctggcctcaagtaatccccctgcctcagcctccgaaagtgccgggattacagaagtgagtcactgcaccccgccctttgcccagcttttaatggagttgattttttttcttactgtttgagttccttatagattctggatattagtcttttgccagaatcataatttgtaaatattttctgccattctatagattgtctgtttactctgttgattatttctttcgctgtgcagctttttaatttaagtcccgtttgtttatttttggttttcgggcatttgcttttttgtcttcgtcatcagttatttgcctaggctaatgtccagaagagtttttcctaagttttctttgagcagttgactgctaactttattattactttaaatatctactactttatttttacctttttctctttcttttttgctgctattcagacacattaaaagttattcagacacattaaaagttatttggagtctcaagttcctcatctgcatttttaatgctaaaccatcagcatttttaatgataaattggaaatcttgggtaacacagaactggtcaaaacaagtaaagttctaaagcctccttttgcttaaatgaaataattgactctcaaagctgagattctcttcaactttcctcctttgggaaatttgcttagtaagtttataaagttttggtttcaaattaaattagatgatacatatttgaggcagtgacccacaactttttcacataatttcatctttagtggccacacttgtgtacagattatttaatccactacaaagcatatataaaatgcattgtatgtaccgggaaagctggcgttttttgtttgtttgtttgtttttgagacaagagtctctgtcgcccaggctggaatgtagtggcgcgcgatttcagctcaatgcaacctccgcctcatgggttcaagcgattctcctgcctcagcctcccaagtagctgggattacaggcgcccgcctggctaattttttgtgtttttaatagacacggggtttcgccatgttggccaggctggtctcgaactccggactgcaggtgatccacccacctcagcctcccaaagtgctgggattacaggtgtgagccatcatgcccagcccaaagctggcattttctgtataaatagttttaaacatgttctaaatgtctgggctgctttttaagtttatagttgtacttaaagatagtataaaagaggcccggtgcagtggctcacacctgtaatgccagcacttcgggaggctgaggcgggtgaagttcgagaccagcctcggagatggttcaaagggagaccccgtatctacaaaaaatacaaaaattggccaggcgcggtggctcacgcctgtaatcccagcactttgggaggccgaggcgggcagattgcctgagtttaggagtttaagaccagcctgaccaacatggtgaaaccccgtctctactaaaaatataaaaattagccgggtgtgttggcgtatgcctgtaattccagctactcgggacgctgaggcaggagaatcgcttgaacctgggaggcggaggttgcagtgagctgagatcacaccactgcactctagcttgggtgacagagtgagactctgtctcaaaaaaaacaaacaaacaaacaaacaaacaaaaaaaacccaaaaaacaaaaaccacacacaacaaaaattagccaggtgtggtggtgtgtgcctgtagtcccagctactcaggaggctgaggcgggcggattgcttgagcctgggaggcagaggctgcagtgagctgggaacgcgctaccgcactccagcctgggtgacagtgtgagactctgtttcaataaataaataaatactatttactgacgtctccaagcaagaactaacttgtaacaaaaactgaattctcatcattgtgtctaaaaaactgctatacacattttcttcttgtgattaacttttttttttgccatagaggtcatgcttgagataacattgtttttgatttgtagcaactgaccaagctggagaatctactttttagataaacaagttaatttgaataacttgatgtatatggctgtaactcaatttcacttttagttagaaaactctaaaaagtagacttttcttggtctgcattaaaatcttacatttgtattatactaaaaaagatgtgctagaaactaagtttaccttttagttaaaccagtagagtaaatggctagggcacaagttttaataaagatttcttgtatatcttctgtgtgctaaactattgttctaggcacctgtgataaggggacttaggacatgctccatgatctcttaagagctcatgacttgatgaaggagagaagagggcagtcatttcctatgaagggaataatcagaattcctccaggaagcagttcatttaataaaacagtggtcaactaacagttgggacttaaaaacgacaacagcaaaagtattcccttttgatgtgtttatatcacctttcacagatgactctgtaatgcttatttgattaattaaaaactctttaatttgggaacagaagggtaacgtaccagaagctcagccattagcctgttgttggagtttagcttattgttttagaaagttgattttaaataattgggacagttaaaaatgctggtctgaactatgtcagcttcaaagtgactggatcagtggttttgagtggcttctatttttggtcacaagctaccttgggaatctcataagaagtgtggaccttcttctcccaagtgatgcacatccatgcacaattctgcatttattttaaaattatcttccctaaggaacttcttggactccagggtagaacctattctaagttggttattggttgtaatgcagctgttctactgaatgtacttgcctccttttgtgttttttccctgaggattccctaaattttgagcccataagcctttttaaactgaaaggttagtaaattcccatatagtatgtcgtgctctacaacttggcttttcagtcacctcttattaaaggttatgttctcacatattatacagataattgggatgggctttggtaattggtaattggtaaaagtttcatgctaaatcgcacatggtcagaagacgagaactcttaggccaactgtcaaccgcagaactctcaaatgtaaatttagctttttaggttaagaaacatttctttctttctagtttctggtcttactaggtcatctgaaaaattcaatgatttttggtcacttttaagtgattcagtccctgagcttaaggtatcagggacaaagtacgattgacagttggcctaagagttctgcagttgacagttggcctaagagttctggccgtgtgcaattcagcatgaaacttttacctattaccaattaccaaagcgcagcccagagtggtatgttattgattaaaatgaaagccctccatggcccagggttgtgtatacaccttcccagctgtcatggaaattggaggtactcatagggacagagtgactcataggggtatctgttatgatcatcaagactccagaggttagctgagccagaaattaatgtgttcattcattcctccaaataatttatttatttatttattttattatttatttatttttgaggcaggtctcactttgtcgcccaggctggagtgcagtggcaccatatcagctcactgcagcctccgcctcctgggttcaagcgattctcgtgtcttagcctctcaagtagctgggactacaggcgtgcaccaccatgtccagctaagttttgtatttttagtagagatggggtttcaccatgttgcccaggccttttttttttttggcgacggagtctcattctcgctctgttgtctaggctggagtgcagtagtgagatcttggctgactgcaaccgctgcctcccaggtttaagcgattctcctgtctcagccgcccgagtagctgggattacagtgtgcgtcaccacacccggctaatttttgttatttttagtagagacagggttttgccatgttggccaggctggtctcaaactcctgacttcaggtgatctgcctgccttggcctcccagagtgctgggattacaggtgtgaaccactgtgcctggccatccaaataatttattgtctgccttgtaccaggcactgtgttgagtgttgggaaaattgtaaacaatacaggtgaacaacctgctcctatagaactctttgcttatcaagggagaaactttaatttaaaatgtacacatatataactcactataataagtgttatcaagtaagtatatatagggtgacatgagaacacataacaaggaacctaatttagattgggtcagagaaagcaaaggtatgagactagatggttattgtaatgcgtagaatgaaagcttcatttctgaaaaaggttttcatatacagtgcctctaaatatatgcttatgtatatgtgtgagatttcagtttcaaagtgttggacatactaaatatcactttatatgataatgtggacccataatcagtcattactattaagatttttcaagttttcttcataacagtgttcttttttcttcctcccttacagtatacactttggaattttctcccaaagaatctgtttgaacagtttagaagaattgcaaatttttattttctcataatcttccttgtacaggtaagagctccttaaacagccacttaacttttagaaacttgattgctttaaacgaattttcaatctatttctaaccttaaaatgccatgtaattaaaaaaagacattccagagcttattatgacttcttaaagtagaaacataacatttaaagattatcattttgtaaatttctaaagttgtgtttttactagaaaacctgttgagattttgtttcattgttactttctttgaaattttcatggatatcatatttttgctcatcccaggatgacgtgtattgtgtaccattaaatgaaatggaatatatcaaaactgaaaatagttcaaactagtagttttattttgttacataccagtttcagcctaattggaaacttctcactcatcttcctgattaccatttttgctctctctcattcatttactcactgtaagggtgagagcctagttagatcaatctgcttctctgtattctttctactgttttgtgttttaaattttagacagtttaaattgtgtcttccatctttaaatctgtaagctattaaaatcttttcctcgccataattacccctgaaaattttactacattaaaggtactttttttctcatttcattttttaaatgaagcagaaaaatcccattgaagttgctccaatgccctgttgatgttaagtgcttctgttgactcactttgaggctttgagtaaatggtactgtaattgaatttagccttgctacttaaaatcagtctgggatataatatgggcaagagcctattttaatcctgaatgatggaagatttgaaaaggagctcctctggatctatggtcagatgtcttacagatatagaataaactacctagaggattctgcttgaaagaatcattctacttggtgggcagtgcatttcatttcagttcagcaaatgtataccactcacctacctactatgtgctgtgcagtaggacagacaacaaaaatggtagcaggtacaatgaagatcaagatatggcttttctactcttaaagaatttatgctatagctgagaagaccagtcacataacagttatgtattcacttaatgtagtaaagccattcaagaagcattaacagaatgctttgggtatacagtgtaagttatcatttttttctacccaagaggaatttgataaggcttcagagaatagatgctatctgaacagagcctttaaggattagaaggatttacttggtggagaatgctgaactggtatttcagggatagggaagagattgcctaaagtcacagagccatgtagaagccttgcgtacatggaagtatacattgtatctacaacacagggtgtatggcagaggcagggcttgttgagggttggagatgagagtcaacgagttgggagggcagactgaactcaaaatcatcctcccttaaatgtagttctttttcagtatttcctgtgtcagtaaatgatgacaacattcacctagacatgctaacccgatacttggaagacatctttaatattagcatttacatctaactcttggcatttttgcctcctaaatatttatagaacttctttccatgcctgccgctaacactagtccaagcccatcatctttcacctagattacagcaatagcctcctaaatagactccctgccttcactcttgttcccttctaattcatcttccacagagcagtaagaatgatcttttcaaaatgcagttctgttcatgtgacctttccttgcttaaaactttcaaggatttcctgctatttgtgggatagagaatgaacagcttactttggcctagagggccctgcacagtctggctcctgcctccctctccagccccatctcacaccacactccctctcgccactggcttcctttatttcctagagacctgcatatactgttcactgtgcctagaaaactacctttcgtctagttaactcctgtttacccttcagacctcagcatctacacacttgttttactgtctgatttttcctgtaagctgccagctacatgaaggcagggacttgtctccatcttgtttaaagcagtatctctagagctttgctgataatagcacaagcgctgacagaatggtgctcagcaaataggtggtaagtgaatggatatatttcaataaaggggttaatccaagctgggataaaaactatgcctgaatttaggactatttcttaaactaactgccatgtagtttgcttttgttttaatgaaaattaatatttaccctactactggaaagtgttttgtctatgtttctgtttgaaatgtttgcagcatgtaagtgctgcatatgagttaatgacaaattttcattttactttcaatttaattttatttacctaggtcacagtagacacaccaactagcccagttaccagtggacttccacttttctttgttataactgttacagccatcaagcaggtaaatttcttatttacacttgcacctgcatttcagtccaggcttgttggaatttcattgtcaaaggctctttttcatatttatatacagtgggtagtatcctttatggatttattttatatttggttcctcttgaaaacctattaaaatgataggcacatccttaatgtatttccttgtttcctcttaaatatctgtgtatgtgggtgtaaatgtaaaagaaagagcaggtaaaaggtacagcccagtcaggaaataggaggcagattttttaatgcatattaattgtttcagcgtggtatgtctgtgtgaaaaactcccatttttgtggatttttaaaaattgcttaagcctgtagcgagaactcaagggaagaatactttaattttcttgttttttccttctactgcttcagggggtagtaggtagaggggacatttcctgttttttgtcagagctgatagactgccacagattgtgatatggatgtctttgaagtattttgaacattttgtatgctagtatgtttgaaaaattgcagatgaaaatggaaacaggaaattggaggtgaaagggtaggttaacaatgttaatcatgttttgtgtcagtccacagcatctgactatttacaaacatatttttagatgatatttaacaaagtgcttttaaaaagggtaccaaagaagcttgcaaaacaaaggtcttcttagcattattgggaacaagattacctttcctcttggggttatctggtcttatatcttgcctaccaggaactataagaatattttatcaagtgttcagttgcaaaataaagacttttggaatgttcttttccttagactgataggattattttctttaacatcataaaattgctggttccaagaatagcatgtgtggttttcaaaggcttttttactgattcattctgctcccaatactggttcatgttaggacctttatttcttcaccagcatcacaaaatgtactctataaagtgatagcttagcattgtcataaagaggacagaagaagaatggatatagtacctgaggggaaaaagtggggggaggcgatgaagagacttttcaaacagttgtgtttgaaaaggtacagacattcttacaacgaaaaaagacaaaggtatataaaaaaggagaggaggtcatgatcaaacattcatgaacatcctttagatcttttggcttaaatctactttagatgaaaagtccaaagtaaaatgagccattagatctttctctgattacttttaactggaaacgatgaataccaatttatattttcttttgtcaccaagtcagttgaaaagtttagctgttgatctctacaacttatcatagcttctctgccaaaacaatccttgcttgccttttctattattctctgtgggtgagaaataattaaaatactcccttggagatgattactcgaacagtctactacagcatatacaaaagattatatgtaagtgattatggctataagaaaatacaaacccaggacaatcttttttcaaattaaaaaatagaattaactaactcaagagtacagttaaaataaatcatagcctttcacacatgaaaatattaagtctccagtgcttgtgttttcattaatgtttaaagagtggagaaaacttttaacacaacaaagctatttatctaaggagtattttgaaagtgtgtctcagatttgctattaaaatgtgtagcattgtctctttagcattctgagtttaaattaatgctataattataaatatttggtgttgactcatgggaggatatagaaatttattaacagctttatttcattatcagaactcaattatatagttatttttatctttcagggatatgaggattgtctgagacacagagctgacaatgaagtcaacaaaagcactgtttacattattgaaaatgcaaagcgagtgagaaaagaaagtgaaaaaatcaaggtattttttcttagtccactccttttttaatggtaaaaatacaccattttaaagtgtataatttagtgtcatttagtactttataatgttgtgcaaccgttaactctatctagttccagaacattttcatcacccgaaaaggaaaccctatacccataagcagtcactccacatttctccctcctcccaggccctggcaatactaaccttctttctgtccctatggatgtatgtattctgaatgtttcatatttcttatgtgtcctttttgtctagcttctttcactcagaatgtttttgaggttcatctgcattatagtatatagcagcatttcattccttttgatagctgaataacatttcattttatttattcaccagctgatggacatttgggttgtttctaccttttgggtattatgaattgctatgaacattgaattacagtttttgtttgaacatctgtttttaattctttgaggtatatacctaggaggaaaattgctgggtcatattgtaattacgtgtttaactttttaatgaaccactaaactattttccatagtgcctgtaccattttacattcccatcagcaacataagagacttccaaggtagtagtatttttttttttgacaatctcaggcaattgtttattccagttaatcattgtttattatttacccagtaagaccctgtcaaataacatttttgacttgtccatgtcaaacactaattttttggttctcattagattttttaaattaaaaaattatatttttagagcagttttaggttcacaggaaaattgagtagaaaatatagagagtacccataaacccactgtccccaaacacattttctctggctgtcaacatcccacaccagaatggtacatttgttacaatcagtgaacctattttggcacactatcacccaaagtccatagattatattaggggtcactcttggtgtacattctgtgggttttgttaaatataggatacatatccacatagcctacatttgtatatatgtacatatgtatccatagtagtgtcataccaggatagtttcactgccctaaaaatcttctgttctcttcctgttcattccttattccccccaacccatggtaaccagcgatctttctgctgtctctatagttttgcctttcctaggatgtcacatatttagaatcatacagccttttcagattggcttctttcacttagtaatatgctttcaagtttcttccatgtctttccatggcttgatagctcatttgtttctagtgatgaataatatttcattttctggatataccatagtttatccattcacctactgaagggcattttagttgcctccgagttttggcaattatgagtaaaactgctataaacatttgtgtgcaggtttttatatggacatacattttcaattcatttgagtaaatacaaagaagtgctgaattgtatggtaagagtatgtttcgttttgtaagaaactgccaaactatcttccaaagtagctgtatcattttgcattctcaccaacaatgaatgggagttcttgttgttccacatcctcactgggttttgatgttctcagtgctttgtatgttggccattttaacaggtgtgtagtactatctcacttttgtcttaattagcatttcactgataacatatgatatggactttcttttcatatggttctttgtcatctgtatatcttcattggtgagatgctgcttagattttgcccatttttaaagcaggttgttttcttattgaattttaagaattctccatatgcccaacaatagttaaatttccttgcatcatcttatagtaatgatgggaggaagactacagagtgggagggtcaccagtgtttgacatagaatgtcttcctttttctactttttcttttctctattctttacatcctggtcaagggggaacttgtgccgaactaggttaggttaagatctgaagtttttgaaacaactgtagaaactcagcattattgatcagcgtaagaaccaaaggcagactgagtacagtggcttacgcctgtaatcccagcactctgggaggccaagttgggtggatcgcttgagtccaggagttggaatccatcctgggcaacatggcaaaaccctgtctctccaaaaaaattagccaggcagtcccagctacttgggaggctgaggtgggaggatcacctgagcccaaaaagttgaggctgcggtgatccgagatcgagccactgcactccagcctgggtgacagagtgagaccctgtctcaaaaaaaaaaaaaaaccaacaacagtaacaacaaacaaaggctgcctaaatgattcatagcatccaatctgttgttcccagtacactacgtaaaattgcaaagcaggcaaaggcctcttacatctctccctttctttcatttcctctttctgattttgttgacactccaccccactcccctttacaaaggcccccatttttcattttccctccaccaagcttcttttccttgaggctgaactcaaccaggtataatcttgattaaataaatgtgaagctattgtgattaaattattgtgtgagatgctatttgatgtagctgtttctggagtgtaagtgtgtgggaagagatgcttattagccagcagtctctaaatagcagattgcttggctggggagtcgggggaaagagtttgttgagactccttttgagcaagagagagacttggtctgcatccttagtgtggtggggagtctttgaagtgttaaagccggagagtgacttgatgatttttaaaaataaaactggagtgaggcaaaatgaaagcatgaatgtgcaatcagagagatatagcttaggcaaaaaatgataagggcttatattaggatgatagtagtattgataacaataataaaaatagtagtcaccatttatatggtatgtagtatatgccaggcagtctttttttacattctgttaactcatttaaccctcaacaacagccatatgaagtaggtatttttattatcctctctttacagatgatgaaaccgaggcataaggaggttaaggaacttgcccactactagtaagttggaaagctgggatttgaattaaagcaagcctaggtgtagagtccatgctcttaaccacaactctttactacctgtttagattttaagggaaatggatatattcaggatattttttggaggtagaataatcaggatttagtgatttaggatgtagtgggtgagagaaacagaaaaaaaaaaaaagaataattaagatagccttcctggttttggcctgagcaactgagggaattacatagtgctattaaagaaaatgctagtgcttttaaataagatgggaaagcctaggagaaaaacagatttagggacagaggtgggagtgaagagaaatcaggaattcacttttggctatgttaagtttgagaaacctattagacatacagttggagttgtcaatcctggagctcagaggaggtgttttaaatagaagttgaaatttgggtgtcatcagtctgtacataccgtatgatgccatgagactggatggaatttcatacagcacagagaatgagacttataataggacttgaggaattccattgtgaagacactattatttttaatggaaggagtattttttggcgtccgaaatatcagaaactagatatagtaagacacctctcaatcatatgtcatgctttagtgccaaatagaaataaaagttatactctagtacttcaaccaatgaatcaaccaaaatatattgaaatattgtgctgagttacagaagggttacaaagaatgaaagagatggttcatgctctcaagaagttttatagtttagcttagtagtcatgccacataatgctaaaagaataaaaatacaagaccataactggtcagaacccagtgagtgcgtctgaaaaaaaaaaaaaaaaactctgaatttagagaacgggaatgaaaacagttttctcacatgagatgggcatgaaatagattgtaaaattcagagaggcagagtgtgaaaacatatggattggggcagagaatgaggaacaatgctaagaggtaaagaagctccttgggtaaaaatgaggtgttaggttagatttagtaaaaggagttgatttgaacatcttttctaatataaatgtttaatgctataaattttcctccaagtattgctttagcaacagcctacaaatttggatatattatgtttacattttcatttagtttaatattttctgatttctctttaattcttcctcgattcatgggttatttagaagtttgttatgtaatttctaaatatttgggaattttctggttattattattttgttttgagatggagtttcgctcttgtcacccaggctggagtgcaatgccacaatcttggctcactgcaacctccacctcccgggttcaagcaattctcctgcctcagcctcccaagtagctgggattacaggcatgcgccaccatgcccgactaattttgtatttttagtagggatgaggttttaccatgttggtcaggctggtgtcgaactccgcaggtgatccatccaccccggcctcccaaagtgctgggattacaggtgtgagccaccgtgccagcctagatacctttttgttattggtttctaatttaattccgttgtgttcagagagcatattttcattttctcattcacaccctttgtgttattgttgtcatacgttttacttttacattttataaagcccacaatatgttactatttttgcctgtgagttgtcttttttggtaataaaatatataaaataaactttaccatttaactttttttctttgagatggagtttgctcttgttgcccaggctggagtacaatggcgtgatcttggctcaccgcaacgtctgtctactgggttcaagcgattctcctgcctcagcctcccaagtagctgggattacaggcatgcgccaccatgcccggctaatttttttgtatttttagttgagacggggtttctccatgttggtcaggctggtctcaaactcctgacttcaggtgatctgcccgcctcagcctcctaaaatgctgggattacaggcatgagccaccgcgccaggccccatttaaccatttttaagtaaccatttttaagtgtacaatttatttatagtaagtacattcacaatgttgtacaaccatcaccactatccatttccagaacttttccattatcccaaacaaagctctattcattaaacagtaacttcccatttctcccttcctcagccccttgtggcctctattctattaatactttttgtctctatgaatttccctatcctcaatactttatgtaagtggagttgtacaatacttgtccatttatgtctggcttctttcacttagcataatgttttcaaggttgatccatgttatagcatgtatcagaaattccttcctttttaaaggtgaataatattccaatttatgtatataacagtttgttgatccatttatatgttgatggacatttgagttatttctaacttttgactattttgattaatgctgctgtgaacattggtatataagtatctgagtttttccctttgattcttttgagtatataacttagagcagaattactaggttgtaattatctttttaaaacctttttttttttttttaagacaagagtctcactctgtcacccaggctggagtacagtggcacgatctcggctcactgcagcctctgcctcctgagttcaagtgattcttctgcctcagcctcctgagtagctggggttacaggcatgtggcaccgcacctggctaatttttgtatttttggtagagacggggttttgccatgttggccagactggtctcgaacccctgacctcaggtgatctgcctgcctcagcctcccaaagtgctaggagtatgggtgggagccaccgtgcccagcctaaaactgtttttaaaagattaacaataagaactatattttatatttacccacattttttcatttccctatgcagatttaaattttcatatagtatcttattttttatccatgaagagctttctgtagtattttatagtgtaaatctgctggaagtgaatgttcctatggaaaagtttttatctcaccttcaattacgaaaattatttttctggctatatagaattatgggttagaggggtttttttctttcagtactttaaagatattactccattgtcttctgatatgcatagtttctaatgagtctttcatttctattcttgttcttgtgtatataatatttctttgatgcctttacatttttctttctattttcagttttcagcagtttgactatgatatacctacatttttttcatcgtagttatccttctcgaagttctcttggatctattgtttgtcggctttgattaactttggataattcttggtcattatctttttgaaatattttttcagactcattctctctattcttccggtactccaattacatgactattatactgtttgatattttctcctttgagtaatttgttgtttttttaagtacactcctttttctcctgtttatatatcactttggataattttagttgctctgtcttcagaattagtgattatttcctttgttgtacccagtccactagttgaaggaaatcttcatctctgataacatggttttcatttctgactttacattttcatttttttgtagtatccctctgccagcattcttcgttcactgttacatgttgtctaccttttccactaaataccgtaccatttaatatcttttttttttttttttttttaagagacagggtcttactctgttgcccaggctggagtacagtggcgcagccatagcttactgcagccttgaactcctgggctcaggcagtcctcccacctccatctccagagtagctgggtctataggtgtgcaactacacttggctaactgttattatcattttttatagagatggggttctgttaagttgccgaggctggtctcaaactcctggccttatgcggtcctcccaccttggcctcccagagtgctggtaatatagatgtgagccaccacaccccacccatttaacatcttaatcatagctgtttttaagtccctgtttcataattacaaaatctggacattttgggtctggtttcatggactgctttatctttcaatgatggctcattttttgcttgtgtttttgtgcatctcattttttaattgaattttgggcattgtatgtaaaagaatggtattcactgaggtcagtggtatatgtgttctgaaatgggcctggcttcttctgtcaggccactagtgttggcggttgagtcaatctagtcaacagttgggctggctttggtttttgatgtttttaatgtgtcacttaacttcaaattccttaagtggtagaatgccattaccttgagctttgtgtggggcctggtgtgccggagagttttttatggtgttcctgttatactatctgctttcagcaacatcctatattcccgagtcccagaggttgcccctccccgccccacgttcccttgccttttctccagtggtagactgctatttcttgtttgttactcagtgtaaggctcttggcaggaacagaatgatttcttggttttctcattccaatcacaatattaagcaggccatatgcaccaaagcctcagggtaagactttctcaatatcctcccccctcatagtaactgaacttctaccttgtatcagcaccaggttattggtatgataggtttcctgtccaattccctgtagcaggtcccatcccctgtagcaggtcacttttgtttctacctctcctctaacagtagtgatgtttccctgagactatgccagggaaggtttcctgcctttctcctagatgcagatgacatttgcttaatatgagaaaggggtctatgattctggcatggtttttttgtgcctatttcttcacagcagtcaccacctgtatgcccgtgccagtgagaaaggttcttttaggtctcctgcctgtatgctttctcatgaacactcagtagaagcctctagagaagagctggtgaatggttgtggtctcttcttgtctctcaggcttgtagagattctgaactgtcatactagctcacacccagtctttaggaattggttaaaaatctagttgttttcttcttacccactttcatggtagccatctcttccttctatgcttggtcagttatgaaacagttcatctgtcctgtctctcctcagaaacacttgttaccctttgaaattcagttcacttggttgctttgcaacctcagctctctgatggactaaaaaatacgtatttgtttttagattatccattttttcctaatgtttgtaatgggaggtggtgatgttctcttgtggcttttaaaatggtaaatagacctctagagttcattgtctaactagatcatgttattccctgtctttaaaagtcctgtacctatccttttacctttagagtgaggcctaaatcccttaggctggcctgctaagccctttgtgatctgactcatacccatcttgtcagtctgagcttgcactgcagatataggggcctttatatttcatatctgactacatcctaactgttgaaaaaatgctctctttgtgtgttttatttatcaatgcctgagagtcatcttccgacctctaatgggtatctccttcttgtaagatgtgttaggattctgtttgttatctctcttctgcatatttaagcataaattgtggttttgtgtaagcaacataagtgtttatgtaagtgaggaaggaacaatccaacaaaataaaatattatttacaagttagttcaattattgatgctgttgatcttggctagtgattaagattggcaaagaaaataaaattcttcctgaataggtcttgaaatcctcatctttatctgccgaatcatattgcaaatagaagttgggtgttgcatgtattacctagcatttcacagtcagtgtgtctaggtcagtgtgccaaatattgactcccttctaaagtgggttatcttctgcatccagcagcctcttccctttacctgaaggtgctgtacaaaagtattatttataattttcaatatgtaccatggtgtgaaaatcttgggaaggaccagactggaggatttcttatatctttccaaaaaaatgttatgactcttcataagttgggagtaaagtagttgcaggatgttagtaataattataattaacacctttgaagtagttaatatgtgccaggcactttgctcagtacttttcttgtatcatcatttcatgctcacattaattctctgaggtagttgcaatcgtctaagacacttatttaaggtcatatagttaagtggcagagctgggatgagaagtcaggttaaagagtccaaacttttaatggttatgatttacttaaccctacattattaaattattcatgatttcttctctcaggtttttcctttccttgagctttgggtacttgctgataagaaattgtttctcattgctatattaagtgattctcctgacagcagatgaattcatagaaagtgacctatagaaaaaaaaaattcaaatattttgggaaaaatcaatgcctctctaattaactgggattttctgagcactgaagaaggacctggcacccaacaacacagttgttaccacatggcaggcaaagtatgttgaagtatgcgtggtacagagtgggagtgtggctgttcagtgttcatgaagtgcccagtttgtgacatgttgtagattttcttgattcattcatgaagtgataatgtcattgtcttatcaaacatttgtgcaagaaatatcagagagcaaacggatgtcagaatcatttattaaaggtaaaggtcagtgctaaggtaatctgaaagcatcctaagtccttctaaccttaaagaggattctgaatattgagtaatattctttcatcacctttcacatgatgtaggatgctgagatactctcaaagccccagagctagagataatctcttgctaatgttttgacttttgtatgagtgtaatgaatgctttgtttggaatttaaaatatttatatttatttctcaattccaggttggtgatgtagtagaagtacaggcagatgaaacctttccctgtgatcttattcttctatcatcttgcaccactgatggaacctgttatgtcactacagccagtcttgatggggaatccaattgcaaggtaacagactaaaccttgcctaaacattttgatctcaggatagttaatcatacaatactgcctcccatcaccctctaatcttttattttttcttatttttattttttcttaggttttatatttgaaaagagctgttatgtaattgttttttaacttctaagcaaacactcgtgtttgggtaaaagggtggtaattacgtgtggaaaaactgagccccaagtaaaagctaccacaatttttatagcactgcttgaatttaatattgacacagcctatttaatatttagactctaaaatgggagtaatcataggcttaaactgtgtgactatacaaataacttcatgtatgctaaccttacaatttgatctatttttttctaaaatgtatattttcattaaaaatgtatattcttgggatgtaggaaacccaacctggagtaatttgattgctatttaaaaataatacttagggctgggtgcggtggctcacgcctgtaatcctagcactttgggaggctgaggtagacggatcatttgagttcagcagttcgaaaccagcctggccaacatggtgaaaccctgtctctactaaaaatacaaaaaaattagccgggcatagtggtgggcgcctgtaattccagctactcgggaggctgaggcaatagaattgcttgagcccgggagatggaggttgcagtgagccaagatcacgccactgcactccagcctaggtgacagggtgagtctccatctcaaaaaaaaaaaaaaaaaaaaaaaaaaaaaaagatagggtgtagtttggaaaatgtttgctttataagtaagttataaagcaacattttatgtacatataacaaattataactcatttataattgcaagtgacttaaagtaaatttggccaaatgggggtaacttatttccctcatacactttctggcacagtcggttttcttggccatggtccagagctccacagggcatgaagatgtatcctctctatgctgcctttaaggagggttactcatgtggctcacctctgggtatgtccttggagggctcctctgtttgtttattccatctggagttgaggactacgactcagtatgtaaaaaagaacctttacctgttggatgactaattctgtatttcaaaagcatggtaatgacctgcttttaaccttttcaaaaacaaagttataatttagggaatgtcaagatataaatcaagaaatctacataaagatttcctgatagtgaaaaagttgtttggagtaagaaaactttcagatagtttcttttttcagttaagttgttctgatcaaatcagctaaaagtacagaggttttcaaaatcaggagatagttttaaatatagttcagacattgccgtaatatttcccccaagatgacgacaacagctttcccttctgcctaagtggtgcgctctttgagtctgctttaacccttgtttgatgatttataagtgggttcattggcgcctgccttgagttctggatgaatcaagtgcataatatacactagtagaatattctaattatctgactaatgcaagacacgtcatctccctgccccttgtacaaaatgtatccatattgaacattttcaagatcattaattaagctatttgtgtaatggaactattaatgatttttttcttgctgttggcaaaattttagcatttttgtgaccaaaaaggttatgttcaattcatatgtgtatatctccattgccatacactatagtgagcaaaataataagtctcagttctgtaaataggaaaaaaaataaatgtattaactttttcacgtggttttagttaattatatgcatgttgtgaatagaattctctcagctgtccatgtcaagaagagcttttaggtttttaattgtctttgaaaccctccttgcggcaggttatctttctaattatttgtaatatattttcataataataccataaaacttattagtgggaaatgttaatatttgtttattctgccaaagcctcttactaaaacataaactaaatttgtttctgaaatcagttgggtgtatgattatgaaaagaaagtttttttggttttcactttttcttctgctttcaactagacacattatgcagtacgtgataccattgcactgtgtacagcagaatccatcgataccctccgagcagcaattgaatgtgaacagcctcaacctgacctctacaagtaagaatcacctggtttcattttacttctgtttgttggctctgcttctctttgctaatagtattgcaaaagaaacacccaccacttaccagcctactctcatttgtgtttttatgggcgattccttccttctggcagaaaaatgaatcaaatcagccttgttcactatcaacccagaataaatcattgtgggcccaggtatcttatgatttttcttttatttttattacttgtaaacatggccatatatcaaaattttagattatgttaccctgtaaggctgatctatcagactgatgcagtaaccagttaattaaataaaaaacaaatccttttacatgccatctaacattaaagagagaagggggatatcctcttcatgcaattagtaggttctatcctttcttagaatgatcatgatgcactaaagattgcaaataggctctttcttgtccacagtaaacagttaagggatgagtacaatggtgtaatttcctctattttactatacttaggctctctggagtaggtttgctgattattagtcattgtgggttgtcaaaaattggcgtttgatttcaagactggttagttgggttgattagagcatagtactaatcagggtagtgtaacaggttttatccccacgtgggctaattaattttatcctattctaccgttgcagatggcatccattacccatcttgttaatgcatgctgttagtcataatgagtgaccaagtggttggatgtggtttacactaacacctagtagtggaaaaacaaagtattcattctacttcaagaacaatgacctccctccttctcatcactttttctttcctctttcccttcctcttccgtatccaccttgatgataggaactagggccaaaaagtgtaacagttattctctaccttcaagggactcactgtgagcaagagatgaagtaataaagctaagcttatacaaggtgataatagaggtgagtgtaaggtctatggaatcacagaaaagggagtaacttattctgcctgagctagagaacaatatctatacccttgcatatttatagggaaatccccacatttttcagttgctttaagtatgaaggagaatgataggacagggaaggttattccttatttccttagacgattgaattccttgctgtgtgacttcggaataccttgtacttctatcactctagtggtaagcacttgcgtcgtaattgcctatttacttttatagggcaaggagccatttcttttttgcttattagtacatcttcagcacttagtatagcactggcacaattaatatatgatgaatgaatgagcaagccttcatattttgtgtatatgagtaatatatatttctattttctggggaaaatgctgtttacgatgcagattataaaacactgatgttaacgagggattaggtatttttaccttattttgcagaaatacaggttaccatacacctattatattaagtgattgggtcaagctcagtattgagatcaactacaagtcacaggctggacatttccaagatggcattcaagtgttcactgtctaagactagtactatggtttaaagagtggtttcaggaccagcagcagcagcattactggggaacctgaatcagaagctcagggatgggacctagaaatctgtggtttaattagcgctccagtgattctgatgcacactcaagtgtaagaactactgaactagcggttttgaaaattgtattttagcaccagaaacctttcttcacatgatccaagatagaagttacgttatttatataaacttataaaagagagaggtgttgtgtgcatgcatgatgttaaacagaacttgaaaatcaattgagaacctttgtttctgctcctataatcccatcatgttatttaaaaattatatgaaaatgttatacaccttatcaattcaacataactttttttcccccagaaatataataggcttttgtagttcattcacagttttatctatctctgttttattatttgtattttcattcattctcatatttctggtacatggatttcacctggatgtagaaaacacatttgcaattttgttctttttacagatttgttgggcgaatcaatatctacagtaatagtcttgaggctgttgccaggtaagtttgctgtttctttaatttgtcctttggttgggggggggggtctatttttctgttaaatcaactaaaatagccaaatacctttctattatagaaaggaatataggccgggtgcggtagctcacgcctgtaatcccagcactttgggaggctgaggtgggtggatcacctgaggtcaggagtttgaagccagcctggccaacggggtgaaacccaatctctattaaaaatacaaatttagctgggcgtggtggcacacatctgtaatcccaactactcaggaggctgaggcaggagaatctcttgaacccgggaggcgaaggtcgcagtgagccaagattgagccattgcactgtaccctgggcaacaagagcaagactccatctcaaaaaaaaaaaaaaaaaaaaaaaaaggaatataaaggtgaataagcaactaaccttgtgattggtagagttgtggtgatagggtctctgtgttgtggggagggggctgttagaagtaatgcttatggtttccaaaatagcagagctccagacattttggattatattcccaaacctgttctagccatgttatttattatcctcggttgtgaagtggctgacaacattggaattataactggagaacagtgggagagtaattgagaaagtaagcagtgggtaaaatgctggaagaactacctggacttacgtaaaatgaaaggcttcattaaaacgaattgttttatgtatacgaattgtatgtatcagccttcatacaatttatcaagcagttcatacaaaaagggatgctttctttcctcttctatcatcatattaattaccgcaacttttccacttggcctttacagccacactcaaaaagttaaagaaatacagggtccccagtgatcccccaaaaggagggtttattctctccaaatatgtcagtatatttttcccaccttgacgtttgcattccctgtcttttattgatggctgtctgcttttgtgtcttgcgatctgctgctctgttctgttctcgtcttgctatccatgattcataatccttttatccccccccatgtattttttttgcctatgtgtgttgctggctactcccgtactgtgcttccatctgtgctgtaccctcaagtaacttcagagtgaaggacctttcagcttgtcctggggagtaagcatatggtataagtagacagataacattctgaaccccttggagataggtgtgtgtcagggcaaaatctgtccccagagttgttgatgctattggcttgtttggataagctgtgttcattttttatttaggtctttgggacctgaaaatctcttgctgaaaggagctacgctaaaaaataccgagaagatatatggtgaacaatttttaagatacacctatcaaaaaatatgctttgtaaaggctgtgaataaatagtgcatattaaaaagtaaacatggcaggtttgccatttaatttaaacctacatttaggtgttgggaatttataacgtggtaaactaagacgaaatatgacaaatactatatataattaaaattatcctataaatgatatacaactggtgagtggaagagggcctagatttcccacttttatagacttaaaaattcatagagccagctgggtgaggagttggttgacaagttcttagtttttattatattctgtaatttcttaggagttgctgtttacactggaatggaaaccaaaatggctttgaactaccaagggaaatctcagaaacgttctgctgttgaaaagttagtatgcgccacaatttatttagtcattattgattaaaatagttactttcttggtaattccaagtaacaagcataacaaaaaacaacatcaattataatagcaactacaattttaagcacttgtttatgtaccagaaactgtgctcaatgatttgtatgtctgatttggtttagtcctctgaagaacactgtgaagtaattcatgttaacctctccactttacagatgaggaaatggtcttggagatggtatgtgacttacctaagctcacatagctattaaagggcagagtttacttgaactgtaaattcattcctttttgctagtggagttaatggtttggagtcctttagttgctatatgcaagttggttctataatatagataatagtctcctggcacctattgaagcagtgcctcgtagatcctcaagccagttgccactgctatagacctcaccctgtatttggcatggataaccagtatatcactggcaccctttccatagctccacttttaaactgaaagaacctacaccgagcttgaggatttcacattgctaccgtgccctctaccccaaacatttaggattcagggaaatggagacaagatactctttctataagggttgagtaagtaatggtgtgtgtatgtgtgcatgtgtgtacctctcctgtcactttacaggaaccttaataaggtgtgttcagctagtcagccattgcacttgggggagcattggtggtcaataaacagttcatggccagcttttccattttgccacttgaaagtaatgctgcagctatgataactgaggttaatacacaaaggcttgtgctgtagttacgcgtcgtacacagaaaaagctttagatgactcagtagtttaattcatatctgactgatgtctttggttttaaaatccatgctatcttatttttcagatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggtaatttgttttctgctgaaaattgaaactattttttgtgactgagccaaccttcactgaaatgctgctcagggaaacggcaccttttgttagcttctgaattttctctcgattacatggtggctctaagccaataaatatttaagaagatttattgtaaaagaaagaaaaagaaaaacaaagttttttttgtaaaaaaaacttttattttctttattgtaaaagaaagaaaaagaaaagaaaaaaagagttttttttcttttactttaggcatctatgcttgtttttagctctttatataagaatttaaggtgaaacaatttggcaagatgctttgacattttaatgtaataggagtatgtgaaatgtcacgataaaagcataatgaatgccttacatatgaactttgatctcacattcctatcttagggtggagtgagcaaagagaacttaaagaagtgaaaaagtactgacagaagtagtatatactgaagaataatgataaaattgagagtgttcttaaatgttctcacatactgtgataattttgactacagtgatgtagtgttattaggaagttccatctttatagcaagagcagtgttttcagcattgaaataaagatgaaattaattcttcctttatattatattggtctgatgaaattgtatgtctaattagcatgaactatctcttttattttaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggttagagcattgttttacttaaaataatttgtcaacgtagtgaaaatatctttttgtgtagtctggattaccaatatatgtgaccatgtcacatttggaaaagtgattcagagaaaattctttaatgcaggcatgtaatgaaggtaagcagtgttttcatagttacagcatcagttcttttgctggcatttttgagaaggatacaatttatgtattaaatttgaacgttactgaaattctccttggaactgggtgatgttacattattagctattgctttggaacaggaaacagtcttcatcaccatctataaccatttgtggatagaatatggggtagcaaatatggctcttttataagtgtattttgttccataagcaaaattgaccagagttgtcctattgacattttcttggtacatttctgatcaggtagaatatagacctaacaagcagagttatttattccagtacaagaatttcaatgaagggaaaacgtgagggcatgtactcctcaaaatgcattcttctttatataccaatgtaacccagactgtgaccccattctaacccaggtgcatttattttccagtgcaacacagtctggctgtaattcttcaagtgatgatttcttaggtgcttttcttaatagtatcgagaaagttttccccttttttttattttactctgtgtcatgtaatgatctttgtgagctgaaggaattttttggcttgcattttattctcatgacatttagaatgtcaagactgtggaaatgtcatttttgtgactgggagtttccaaattcagttaatgaaactgtgtggctggagcagagcctcacacttgtttaaatggggctgatttgcattcacacctcaaaactcttacttcctggctttaggcctctccgcagtccatgctttctgtttctactcttgatatagtctttgcctaaatcaaagtacccacatgacaactgcagttgaaaggtagaaaggactctccagataccattttgtttagacttgacttcaggacaccagtatctgaaaccatggagtctacatcctgtgtagataccaaggcactaagaatagggcttttcctttggatattgttcccacaaggttattttgttgacaatgtgggctgccgtacctgaccattgtcttttaggccagaagttttcatccagggttagagctatctgagtagaactgctctaatctcaataaaaggcatcaatttgcagagtgcatgagaaaaaattttgagtatacaagccaccttaagtgaacctttccctgacagttaatttagtggttcattctagatgctgagcaaatctgcctgttctggatttagtgcctggctgtatgtgttaacctactcaaggttgagcatgactagcttggggctagcctcaactactattacaaatagaatagccatcattccgaatatgacacttaatgttcactaaaaacagataagatgcccgggtcaggttccatttgatgagactcttacctctttcagatcttcatttcagcagattccatattacctatgggaatgcagtcttcttatcatctagactatgttaatactgcagaaagtaaagtagagctttgggtaatgatctagtaaatttgatgagtgaaaagaagctgcagtcttccttttagtcaccactcctttctcccaccaaaccttgcatttctagctgtggttgtcatttagtcaaatcaagttaatagccagaccatcacttcaattaatacagtgtataagcaacttgccattgttatcagtttgcatgtatagaaacgacctaaatgaaagtgcaaagaagtcttgaaatggtttcttaggccatttagtattcagtaaaccagtacacacaaaattaagtgtaacctgttttttctttgttgagtcaaatttaagatctgtgtaactttttatgttactaaaggcaatgtcatttaattcctgttcataccattgcaagcatttgcttaacctcttttaatgtgacccacactgggattaagaatagaaagatatgtttagaacagtgcttgacatgagaaacaaaaggaagtagactgctcagctcagttggaaaataatgcagtcttttatgattagacatcaatcttttagacaaccaaatgattgtaatccatattgaaaaacccgtggggctactcttctttgtgtcgccttcccatcttgcggctctgcctaatggtggaactttatagtgtgagtatatattctgattccaataatttaagccagtagctgttattcaccttttactgtctgggatgtgtgtgtgtgctaggtattattatgaagtaaacaagaaaccctcaagtttttaaaaatatcactggggagacacacacatcagacctaactatagcaatgtgatcataatcaatcagaaaagatgtggggcagtgcaaagagtctggtgttctttgattttggtgaagtcaacatcagtgacagtcaccatgtatatagcaccttttaggttatagatcattattattgagctttattttttaatctttacattcttgtgcagcaggtatcgttaaggttaatatttgaagttcatagagataaagagattttcctaaggtcacaaagttagtaggtggtggagccaagatggagtccaagtgttccattaagttgaaccattggtaatttttgatctacaaaatagatcatttcacatgttcaacatatacttcagagccttttctaccctacagcagttgtctcactaagagataggaaaagaaaatcttttttctttttttagaaattatattcaatgaaatactaattaacccataaaagttattatgtaaatctatattcttgacatggaaatacatatgtatatgtgtgtgagaaaaatagattacgtagcaaacataatgagattacatttctgttcaagtggtaaatacacattttaccactcaaaatattaacatgattgtttctgtatgatgggattaatatgtgtttcagggaaaactcccaaaatgtgtttttactgtgctctcacagcaaacaacacagagacttctgtgtccaaatgtgggagggagcagtttctctcaccgacaaacagtgaacaccaactgggtgtcctctagttcaattctgtctacctggagataacatcagatcccacagggtgagggcccagtccccaagactgccccatgactcctagacaccagtcacaagtctgggcctccggaacttctgatcgaccagctttaagttgggctacccacaatcccctctttgggtttgattaacttgctagagcagcagacagaagtcaggaaaacacttaacttacgttcaccagtttcatataaaggatattgcaaaggacacagatgaagagacatgtgggacgatatataggggaaagggtgtttagcttccataccttccttgggcgcaccaccctccaggaacccctacatgttagttatccctaagaccctgtttttctttcattattctcacatagccactcaacacttttgacaaaaggtatgtgaagttttttcctgacacaccaagcaagcagttctccagcaaacaccagctgggtatcctccagttcacttttgatactgcctacctggagatagtgtatcatgtcagatctcacaggttgagggctcagtcccataagactgccccccacttcagatgccagttgctaattcaggttgtaacgtatgcttctgattgaccagctataaaatggggtccagtagtttactagaccccctccttggatttgattagtttactagagcaggtcataaaactcagggaaacagtcatgtttactggttcattataaaaggatatgacaaaggatacagatgaagagatgggtgaagtatgggggaaggggcgtggagcttccatggagcttccatgacctttctaggcatccttcaagaaatttcatgtgttcagctatccagaagctctttgaacctagttttttggggagtttatggaagcttcattatgtggggatgattgattaaatcattggccactggtgttaagcttaaccttcagcccctctttcctccttccccaggtcaggtgtggggctgaaaatcccaaccctgtaatcatgccttggtctttccagtgacctgcactcatcctgaagctatctaggggccccgaaccacttgtcatctcattagcatgcaaaaacactgttatcactttggagatactaaggctttaggagctttatgtcaggaaacaggaaggaagatcaaatatatatttatcaaatatattttacaatatcacgcaaatgatggctttgagcttactgatacagaggagtctttttggcaagcttgaagaagaagagaggctgcttgagagtcagagtaaagcagcagcctcccccttcattcctttgtctctgttaaatatgagaatagttaaattaattacagtcgatctactcctcttctttttctgagtatagatcatatattagggcggtggttctgtaaatatgatcctaggaccagcagcatcaacactacctgagaacttagaagtgtaaattatttggtcctacctctgaccgactgattcagaaactctggtgatagagcagtgatctgagttttaacaagacctccaagtacatgtgatgcattctacagtttgataattactgcatttgggtataatttataggcatatacctgtgagattcaacgtatccagattcatactgcccaaactgtttgaaataggtgaataaattgtactttatattttaaagctaccatctttgacactaacaaaagagattctaatgctcatccaagtgcaggagatgaaataatccaggacacccttcagggaaaaatgaaggttaataattttgatcagaaaaaagccccaaagaatttcatttaaactggaagaatctaaatgatacacaagtaataccacttggattaatttaaagagagagttcaaacttggctggcttaacagaaaaaaaaaaagattggaatgctatatttgtgccagtgctgctaccgtgaaaagctttgaaaaataattagaaagcaactactgctgtagttcatctctttctcccttacataataaaaaccttaatcttgtccttatgcttgttcctatcagcccataattttaactatttaagcataaattgccaaaacgaggataaaattgtgggtttccaaaagccagatgttaaaaatagaagagataaaaaccgagataaaatagaaatgctcaaaatgatttatcttagtggcaaatttatttcttggcttatattttccattatttatgaaaatatacttgtgttatactttatctgctttttttctaaatttggaaacttgagtattttcaaaatatgtatagtaaaaagaaagaaatttcagttatggttttgatcactactgacctatactgtatcttccaattaggtaactgttaatgttgttattaattcttatgtatattatatgatgtggtgcattttattttaattcagtatttttatagaaaattttacttttaaaaggggaaaaaaaccttcatcagtttctgttttattttgttacatcccatttaatttattgggaaaaaatttttaatgggtaatgtacgtactagcccacaaagtgtaagagtgtgtgtgtgtgtgtgtgtgtgtgtgtgtgtgagtgagagagagagagagaaataagtggtcagtatagtcttacttcccacttgaaaaattgacttatgtaacttctttacatcaaacaggttaactggctgggcatggtggctcatgcctataatcccaacactttgggaggccaaggcttgagcccaggagtatgggaccagcctgggcaacatagtgagatgctgtctctacaaaaattacagaataattagcctggtgtggtggtgcgtgcctgtggtcccagctacttgggaggctgaggtgggaggattgcttgagccaagaagtttgaggttatagtgagctataatggctactgcattccagcctgagtgacagagtgagaccctatcttaaaaaaggttaacttaaatgagaagcgttcttagtttgataaaatagtcacttttttttttttttcctgagacagagtctcactctatcacccaggttggagtatagtgatgtgatctcagctcactgcaacctttgtctcctggattcaagcaattcttgtgcctcagcctcccaagtagctgggatttcaggtgtgtgccaccacacccagctaatttttgtatttctagtagagacggggtttcaccatgttggccaggctggtcttgaactcctgagctcaagcaatcctcctgcctcagcctcccaaagtgctgggactacaggcataagccaccgtgcctggccaatagtcacatttttttctattcatcttttacatttgagtagatctaccttagacatgtgatagcattttggtgtctttaaaaatactcatttattcctcatttctttggtaatattgtctctgtaattccctgacatttgacaagaagtcttagaaggggtgatttcctatggatatgaaaatagctttgcgttacagcaaactaaaaattagtcacactgaagaaactaacaatatatgtttgtgtccttgttttaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataaggtgcatttgcattattgttttatataagaaaccaatctgtgtatgcatgttaacattccatagtagaaaataatttttaggtggacacatgacatagacttttgtgtttttgttttttttttttgagatggagtctcactctgttgcccaggctggagtacggtggcatgatctcagctcactgcaacctccgcttcccaggttcaagcgattctcctgcctcagcctcccgagtagctgggattacaggcgcctgccaccatgcctggctaatttttttgtatttttagtagaaacggagtttcaccatgttggtcaggctggtctcaaactcctgacctcaggtaatccaccaccctccgtcccccaaagtgctgggattacaggcatgagccactgtgcccagtgactttagaataactattgttggattcacctttcttgttttactgacacttctgaaatttgtaaatgagtagaatttacaagtaaagagaattgtgggaaatgacatttgggtaaaagcttgcttgtctgtatgatcataattttttgtgctttgtcttttaaaatgtaagctcctccaagaatgatgtctgttcaaatgattaaagtctcaggagtgtctaggcattaaattaaccagagtctccctacacttgagctattgctagattgtgaattagatactgaatgaagttttttaggccatgaagaagtcactgctttggcttaggtggtgccacaataaccttaatgagttaacacagcctatagggtatgctagctgagaaccaggaactcttattaggtactaggagaatatatagcagatttgagtgttaagaatttatacgtatctgctactaagtttgttagaagttacaacattctctcacattaatatattttctccgttcactgcctagttaccgggtgatcaaattaaaaataataatcattattttgttgctgttccacagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtaaagtatactttcttatacttctcctaagaaagtgaaatcacaggaggacagaagttatttgtttttttccgtttgcttcagtgaccttagcacatacatctcctattatttaataaaaaacacaactgctttagccaaaaatttgtggaaaattcccacacctaaccagttaagactaaaaagaaaatagttacaggtaggtattacttgccttactatttatgcatgccagccagaagtctgaatgttcatactatgttttgcaaataacataacagtggccactttttgtacaacacatgttatttctgaggtgctcccagcaattttgacatcatttgagaaccgaaagtccagttttacccatgaggttcaagataattaagtggctcaaaggtcacccagtgtgttagccgtagaatcagaaacccaaattgtctctcccttggttacaataattgtggctgggcattgactttctctgttatcaacttatccaggaaaagaaagtacagttatatgttgagatcatatgaaagagaagaaaagcataaacaagcatgagttaccccattgaaagtaatcattctagaccaggtgcggtggctcacgcctgtaatcccagcactttgggaggccaaggcgggtggatcacctgaggtcaggagttcaagaccagcctggccaacatggtgaaactctgtctctactaaaaatacaaaaatcagccgggtgtggtgacacacacctgtaatctcagctactcaggaggttgaggcaggagaatcgcttgaaactgggaggtgaaggttgcagtgagccgagatcgcgccactgcactccagcctgggcaacagagcgagactctgtctcaaaaaaaataataataaaaaaattaatcattctttagagatacacaaggtcttttttattgtttttgataggtacgggttcacatttttaggaaatcgaaatggatatatgagagtagagaaccaaagaaaagaaatagaagagtaagtagctctgtgtttgatgtttgtcatttcttaaccccatagtcaaatttaagtggattcaggcagggcagcaaaggaaatgatgccactaaaaatacaggaccctgctctcccagttcagagttttatgtaaatatagttggggtagaagccatgttacatagaattgcagaaactggagtttgaggtggaaattccaatctggttcacatctgggtccagtagccagaatgagagtttgcctggaatgtttctcaaatttagatgccatttcaggtctctaacacatgctacaggaaaaatcagtgaatatatgtgaaaccttctgctatctagtgtccaagcaatcactctgggattgcaagcccaggcaataaaggcagctttgctgtaaaccagaagccttgtttggttcggaatgttcaggtgtgagcctcggggcaagtactctgatgctccagtgtcttcacatttcctcttttgccacaaagaccctaatgaacaaagccaccttatcttaatggtggattttaattaggctctgtgattaatttgaatttcctcatctgaacttgaaatataattatgttatctgactttcattctggcccctaggatctcctgagacccatctcagaaacctgtaatatgtttacaggtacttgggtaatgcacccttttggagagagattcatagaagcccagaggaaggttcttggtctgactgacagggacccagggtcattgtcagagtttagattctagcccatctgcaacagtgcccacatctggccaacagcaaaccagatgccatgttagatgtcttatacatatactcccgcaagactaatgaccccctcactcccaccaaaacaagctatgtagtaaatactttttttaaaaaatactagttgtttattttcaaggaaatatttcctctcactttttctaataaccaactcttattttaactcttctgtgtctctccattgattagttcagccatccacacacacatttgaccagtctcatcatgtcattccactgtttaaacccttttattggctttcttttgctcttacaatacaatcccaaattccagaaatggctcacaaagatgtgtttccagcccctgcttacctttcttgctttatctcttactattcccctattgatgagttttttgggcattggtgaactacttaaagtcttccatgggccatgtgctctcatgctgccgtgctcattccctctactcagaatgccatggccccctttcttcatcatattacccttgcagaacccagctcaggcatgtcctcttccaggaaacctcctttcagatgacttccttctgtgttcttatatcttccctgtaagtgcctttattacagtatttgagaaactagaagggtagttatctcattatgctctgtctcccttatcatatggtgacccgcataagggaagggactcaggcagattcacctctattccccagcacctagcactgtgcctggcactccatacataaatgctgctaaaataattggcagagtgggactgtttctagacccctccaaatatggcttggtgggacagctctttatcttccatttttatgtggtcattctccttaccattttaagtaatatactgaggggctataaataccccttaactaacactggtgtcctctgacagcatgttctatgttcagagaaattctgagacaaaggaaagtaccagttgtgcacacaaccagtgctatctgttgatttaagatgtttaaatatcttaacatatttctgttgtgctttatttttctcagtatattctaggttttttactttgctcatttctcttaaagatatgaacttcttcacaccttaaactttgatgctgtccggcgacgtatgagtgtaattgtgaagactcaagaaggtacatgtctgaaaagcttgaatttttctctttgttgatttgtaggcttattggttgattcactctttcaggaaagagaatcatttcatgtagtagtgtaggattagtgaaagtcatgcaaagcagtagcttttgcatatgctttcatgtatttttttaagcacagatgttctgtttaccaaattgttagtgacagaacccttgttatgacagggtgtgccttttcttggtagcagaaccatatccctctgccttgggtgttcgaacaggaactgaaaggatgacttttatatggttcagggtactgaccagtctaccagtaatgtttacatgcagccacccagcatagttggatggtttgggattactagcagcagaatccttgagtatagggagttgcttgttatccctcactgaccttcctggttcccctactgcttgacactccctggaaacaggtgaggtagagaggactaagggcctggtttctgggaaatggcattgcagtttcactccagagctcaggttctttgttgagcagagtaaagcttgccctttgcaggggaactggtactgtaatcctgggctccctcatgtctttggaggcaccatggtggtttgccttctgctcagattctgcaagacccatgggcgagcaatcctgctttattcgaaggctctcagatacgtgtgtgtgtggtgtgccgaggtggtttgttttctaaaaatttttgatttatttcccagtaatttacgttttactattaaattttctaaattccttaatgtcagaatgggaggatacagacagatccttgggggaacatatcccacttaattcatactttgtggtgtgattgcaaagtcatgaaattgattttaataagtgaccatggagtttgttttgtgaattttaaaatacactttggatgtgtaagaataaatgaaaaaaaaaacacaacatttcaaatacttgctattcttatgtgtgcatgtccacatgttctacagcaaatggtgaaatgtctgtggaactggtctacaaaggtcattgacctcagagctacactttttaatttgttgacctcggttgtttcccttataaggataaagtgtctgtcttagtgcacaactgtgaatatttcctgggtgtgtgaagtgatctaaagctgcaattataccagcattctacaaagctattctcatcagtaaaaactatcaagccattgttttagaagctagttaatatagtttattcaaaattatttcagcttgtttgagcttgagctttcttcttgacatctgtagatgccatatgtgtgctctaggccatggcttcactgcatttttttttttttaagacacggtattactctgtcatctaggctggagtggcaagattatagctcactgcagccttgacatcctgggctcaagcaatccttccacctcagcatccagcgtagttgggtctataggtgtgtaccaccatgcctggctaattttttaatttttagtagagtcagggtctccctgtgttgcccaggctggtcttgaactcctgagcttaagtgatcctcccacttcagcctcccacaatgctgggattacaggcatgagccactgcacctggcatacattttcagaagaaattcagatgcagctccttgacacaagcccagccctccatgaattggtgggaggaagtatattttaacagaggtgcctattgtaaactctggcttattaattgtgttcataatgaccttgaagaggtggtacatgcctttctgacagactgaaggccaagatttctcattccatttaggtgagtattgcaaggtgtgctcagaatatacaacacttgggtgagagagaccgctttaaaagttactcttactaaaaccacaataccagccttaaaattctaagtcaagtactatggttctttattttaggagacatacttctcttttgtaaaggagcagactcggcagtttttcccagagtgcaaaatcatgaaattgagttaactaaagtccatgtggaacgtaatgcaatggtgagcctatactccttcccccaccaataagtaagcagagaaatgttgaaaatgactatgtttattggatttctgtttaaatgacagtttaaatacattttagcttatttttgtggtctatgttttgtatttggggatttgataatattacttttttttatcttaatataaaacattttcctggagcaagtttcaggtcagaatttgcagccttaaaagacttttcaacaacctttgttaaaagaactgttacttcctttttctgaacctaattgaatgttaccttttcagttgtaatttcttcattttttcagactaaatatgtgtcagaatttctcttgtccatatggctaaagcaagagtatttacagagtgtgtttttttttttttccaactattattagaataactacagatctcctactttactcctaggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagtaactagaaaatgatactcttattattttaatgaccagtgttttgggtgtgatctgccccagattagtaatttaatctcgaagtttgaaatctttagttttattgtttaagtggacttaaagatttatttattatagcaagtatgaaaaattacaccagattttgagctgttagtaggaatgatttttttttaattttttaattaatttttttttttttgagacagagtctcgctctgtcgcccaggctggagtgcagtggcgcggtcttggctcactgccagctccacctcccaggttcacgccgttctcctgccccagcctccagggtagctgggactacaggtgcccaccaccacgcccggctaatttttttgtatttttagtagagatggggtttcactgtgttagccaggatggtttcgatctcctgacctcgtgatctgtccgcctcagcctcccaaagtgctaggattacaggcgtgagccaccacacccagccagtaggaatgatttttaaggtaaattcatgtaacctagaagaatgaatcagttttcactcaggtcttttgaatatttactaagctatccatatatttatgcacatattatcaaatagtcttgacatgtttagggaagggtactacagccattgtttgagctggtgcctagacaaaggggtaagattttcagagataggtgagctgaaaggaaatttaaggtagagtgaacaacatgagagcttaatctaacctggttcaacagaccagagtatgtttttgcatgctttattttattttatttttatttttatttatttatttatttttgagacagagtcttgctctgtcgcccaggctggagtgcagtggcacaatctcggctcactgcaacctctgccttctgggttcaagtgattctcacacctcagccaccggggtagctagctggaattacaggcatatgccaccacacccagctaatttgcatatttttagtagaggcggggtttcgccatgttggccaggctggtcttgaactgctggcctcaaataagcttctgtcttgacctccgaaagtgttgggattacaggcatgagccgccgtgcctggcctgcatactttaaaataatatgcttttaacttacaggctgacctttttcagacttgattgcaggacactgccattgatctgcttgaaataataagttttaaattcttaatatttttagaattttctaaatattatatatgaaaattatgagaattaaaaagttacaaacatatgtttagtcacgttaaaaggtattgaaactctaatgaaattcctttagtctaatttcattgttattctgtggccaaaagaaacccagaggaaagtatcgtttttctcttgtcgtctttaagaattataattaaattcacattcaggatgattggcgttcctctttttttggagggtgggtcggggttatacattcaggtagtacatgtgcaggttcgttatgtggttatattgtgtaatgctggggtttgggcttccattgatcccatcacctaagatattaacataatactcaatgggtggtttttcaaccctcactcccctcccgtcttcccccttttggagtccccattgtctgttatttccatttttatgtccatgtgtacttatttattagctcccacttataagtaagaacatgtggtatttgattttctgcctctgagttatttcacttaggatagtggcctccagctgcatccatgttactgcaaaggacacgattttacttttcttatggctgcgtagtattccagcaatcttgcctgattgctctggctaggacttccagtactctgttaaataggagtggtaagagtggatatccctgtcttgttccagtttttaggggaaatgcattcaacttttgcacattgagtatggtgttggctgtgggtttgcatgtagggttcttattattttgaggtatgtttctttgatgcctagtttgttctcagggttttttttttttatcatcaaggtatgtcaaattttattgaatattttttctgcatctattgggatgatcatataatttttgttttaattttacgtacgtggtgaattacatttattgatttgcatatgttaagccgtccttgcatcccaggaataaaacccgtttgatcatgatgagttatctttctgatgtgctgctggtttcagtttgctagtattttgttgaggatttttacatctatgttcatcatgaataatggcctatagttttctttttttattgtgtccttgccaaatttttattttaggatgatactagttttgtagaatgagttatggaggaatctcacctcactgatttttcttggagtagttttaataagattggtaccaactcttctttatatacatctgatagaattctgctgttaatctctctggtcctgggtttttttgattagtagattcgttattactgattcagtttcatagcttgtttagggtttctttttccttctggttcaatgttgggaggttgtatgtttccaggaatttatccattttgtttgtgttttccagtttgtgctcgtagatatgttcataatagtctctgaggatcttttgtatttctgtggtatcagttgtgatgtcacctttgtcatttctgattgtgcttattttaatcctctctttttctttgttaatttagctactggtctgtttgtttttcatttttgtttcattgatcctttgtatgatttttttggtctcaatttactttagttctgctacaatctttgttactcctctgttagctttgggtctggtttgtttttgtttttctagttcctttaggtgtgacattaggttgttcatttgagatttttctgcctttttgatgtaggcaattagtgctataaactttcctcttaacactgctttttgacatatcccataatttttggtatattgtgtctctattttctttggtttcaaaattgttttttggtttctgccttaatttcattgtttactcaaaagttattcaggagcaagttgttcagtttatatgtactgatgtggtcttgagagttccccttggtattgatttctaattttatttcactctgttctgagaagatgcttctgtatgattttgagttttgaatttcaggagacttgctttatgaccaagcatgtgatcaattttagagaatgttcatgcacagatgagaaaaatgtatgttccgcagttgttgagtagagtgttttgtaaatgtctattaggtccatttggtcaagagtccaatttaagtccagagtttctttgttagttttctgcctcgataatctgtcttgtgctatcattggggtcttaaaatcccccaatattgtatggctctctgtctctttccttaggtctagggatgattgttttatcaatctgggcactctgatgttgggtctgtatatatttaggctagttaaatcttgttgaattgaatcccttttcattatgtaattcccgctttgtctttttatttactgttgttggtttaaagcctgttttatctgatataggaagatcaaaccctgctcctttttgtcttctatttgcatgatagatctttctccatccctttagatttagcttgtggtcatcattacgcctgagatgggtctgttgaagtttttgagacagagtctcactctgttgcccaggctagagtgcagcggcgcaatcctggctcactgcaacttcgcctcctgggttcaaaccattctcctgcctcagcctcctgagtagctgggactacgggttgcctgccaccacactcagctaatttttgtagttttagtagagacggggtttcaccatgttggccaggctggtctcgaactcatgacgtcaggtgatcctcctgcctcagcttccttaagtgctaggattacaggtgtgagccaccacgccctgtctaacagatggtatttttgtattcattgcggcaatctatgtcttttaagtggagcatttaggccatttacattcaaggttaatattgatatgtgaggttttgttcctgccttagtgttgttagctagttgttttggtagtctcaagtatataattgctttataggatctgttaactttctactaacatatgcttttatagtagcaaatatcatccgtttgtttctgtgtttagagctcctttaagcatttcttataggataggtttggtggtgacagattcccatagcatttgcttgtctgggaaaaactttatttttccttaatttaagaagcttagtttagcaggatatagaattattggctgcagttgtttttctttaggaagtctaaaggccaggtatggtggcttatacctgtaatccagtgctttgaaaggttgaggtgggaggaacacttgagcctgggagctcacagccagcctgggcagcatagcgagactccatctctacagaaattttttttagataagtaagcatggtgacacgtgcttgtagtctcagctgcttgggaggctgaggtgggaggattgcttgagcccagaagttacagtgagccatgactgcaccactgctacactttaggtgacagattgagatttttctctcttaaaaaaaaaaaggccaaactacatccccaatcttctggcttctaagatttctgctgagaaattcactattagtctgatgggatttcatttataggtaatttgtcctttttatctagctgcctttaagattttttttttcttgttaaccttgggtagtctgatgactatatgccttggtgatggtcatcttgtgtagcatatcacagttgttctctgaatttcttgtatctggatgttgacctctagcaaggttcaagaaattttcctgaattattccccaaatatattttacatgttgcctttttttcttcttttctctcagaaatgccaagaagttacagattttgttgctttacataatcccatatttctcaaagactttgctcatgttgaaatttttttttttttatctgactggattaatttgaaagactgttcttcaagctctgcaattctttcttctgcttggtctagtctattgttacagcttccagctgtattttgaaattgctgtagtgaatttttcaattccaggtgttctaattggtttgttttattatagctatccttatctttcatatcctgaatcatttttctggtttctttgtgttgagtttcaactttctcttggatctcgttgagttgccttgcaatccatattttgaattccttatctgtcatttcagacttttcattctggttagcctgtattattacagaggtagtacaatcctttgtgtgtgtcaagacaccccagctttttgtaccgccagagttcttacactgattccttctcatctgagggatctgttgcttcttatttttgaatttgctgtagtttggatgagacattttttattttttaattcttttttcccttgaggatatgactgtggtatatgttgtgtatgattgtttggctttgtttctgggtgctttcgacggggcaaggctctatatggtttccttggttgtggatagcttcagtgcagtggctttctcagatgctgtttgctgtagtgatgtattggatgcaagggctgacacactgcctcccgcagggctaagggtgtggaggtgtcagaaagcttagcatgtgtactagcactaagcccttctggcagcaagttatttatttggtggtgcagttcaggcttcagtctggtagatggagtttaagagtaagagtcagttctccctctgggagatgatgagtggaagcacctaccctgagggaaggatggtggcaggggttggagatcaggttggggtatgctgggtcttggggaaaggaacaaggaggggtgcaccagctcctcatcctgtgcaggtaggaagatgatccgcttctccattatgcccctgtcgtagggctcacaatcttcagtttgtatagactttatcctttggttcctggttacattgtggctgcagaccatggatacatctctctgatggttgccaccaaaatgggctttggccgagcctttcccccaagttcagagcagacaactctgcagcttacctgtctgttgctgggatgctgctgctctgtgtagggagttggagttgggccccaccctttgtgaaagcccaattggcctgagctcgttttcagcaggggtagagccactgcgaaaaaggtgaaaagtttctccaggtacatatgcgctaccatccactgggaagaactgctgctggctgcatcaacaacagtgtacagggggtggacacagtgggaaatgacccctctccatgactgttcctggccctcagtgctacccccttcagtgattgtcactgtgcccacatttcttttgtcccaggagggcccttagcaggctgtgcttacctcccccttaggggcagtccatgccgagggatagatctccagggatcccatagctccctggggactcactgatccccatgagcttgccaaagtcagagcgggttggagtatatttgcagggaatctgatggtatgataactcaagggcagagattcccctaggtagggcattggcccactacagcagcacaaacacagtggttcctgccctctaagtttgggtctgaggggagtactgacatgcctgcatgagctggccacctggatctctgtccctgggaagctcctatatcgccactgatggcattgccctaggtaaggagggcagaggggttccccagcagtttgatgatcaggagattgccacaaggtgagggaagcagagaagcatttccacctaccctttacatggggctttgagttccttaagggacagtctctgccagactctcgcttcttcccttttctgtatcccagctttctcttgtgggctctccaacaggtcctggctctcttcccacagttttcagttcagaagatgtccattcaccagtaactttgatcttttttatgaggacaactggcatttgatgtccctagtcagccaccttgaaaacccatgttcctgttcttaaagctcctcaaggatagggattcactaatttccctcatcatctgattagaatgtttggacctttatactttgaatgatgttaagtgatgttaattggtatggttagatataaaatgaaacatgctaaagtgacattgagtacaaatgtttctgaacattttagcttagaatgatgatactcaattctgccattggataccagttacccaaggtgtcacaaacttttcagaacctcattgtttgaaatttgctttaataagtaaaattatgcccgagacaacactcagaatgagtaggggatgtatatgaaagtcaaccgtgataaggtgtcaggactctagaattgctgtgaattataaaaatattctctttaataagccttcctgtagaatctttgtcaggagttttagaagatcacaaggtttcttttgtgttcccaggctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaagtaagaaagtacatcagtttcttatatttagacattggtgtagatgtaaatcacagctgcatatacaaaaggcttcattttctgtaatgcatgattttctgtttgcaggtgttttatccttataagttaaaatcgtccctgaggacttgaataatggcccatctgagattatttggcactttccaccttttcttttaacttaagagaaaactgcacatttcggaaggtttagaaaaatagctcaatttttaaatgtttagagtctaggtattcaatgttgatattctggcctggtccatgttaagaaaaaaatattcctttcacagtctcttaaattgaatgtaataaaatcaatctttatgacaattttcatgcattttgaggttctggagccattttctgtgcatttttataccccagagctccaaatggaatcaaatacttgttaacgtggccactttctttagaggacatggccgctttgactctactttcaactaggaagaacttgtggaacataaaggtgtcagggaaagccactgataaacaataattcagtgcccagagatatattttctatacttcccattgaccaagggtgagctttgtctaaaccaattacttgaatttaccttggccataagcaaattgatttccttttttgaaatgccactggatgtgtctgtactaacttgaaatatccctaagcaatattattttcaatttcttaagcacactttatgttccaggaacagtgttaagggctttgtatgataattattatttaatcatcattaacaacccagttaggcaaccgtattttcttcatttcacagatagagatcacacagctaagaagaagttcagaaagtctctccaattccagatcccatgcttataacaactatgctatatctgtatcctcatcgctaatgtttaagcaagctttaaaaatgattagcccacattcatgaggctgtggccaattctaaaacagctgttgttcttctagtacttgggcatcagtgataataaataggtttttattaattgcctatgagaaactttttcctttagccaaatggtacttctaaagatagtccaaagtatgtgcattttacttctccttttgtcttagtctgcttgggctgccataacaaaataccatagattggatggattaaacagtagaaatttatttttcacggttttggaggctaaagttctgtgattggagtgccagcatggttgggttcttgtgagggcttttttctggcttgcaaatggccgccctctgctgtctcttcctcttataagggcagtaatcccatcatggaggccccaccttcattaactcatctaaagtcagtgtattagtctgtttttacactgctgataaagacatacccgaaactgggaacaaaaagaggtttaattggacttagagttctgcatggttggggaggcctcagaatcatggcaaaaagcacctcttacatgacagcgacaagagaaaaatgaggaagaagcgaaaacagaaacccctgataaacccatcagatctcatgagagttaattcactataatgagaacagcataggaaagaccagcccccatgattcagttacctccccctgggtccctcccacaacacatgggaattctgggaggtacaattcaagttgagatttgggtggggacacaaccaaatcatatcattctgcccctggcccctctaaatctcatgtcctcacatttcaaaaccaatcatgccttcccaacagccccccaaagtctttcagcattaacccaaaagtctacagtccaaagtctcatctgagacaaggcaagtctcttctgcctatgagcctgtataaaatcaaaagtaagctagttacttcctagatacaatgggggtacaggtattgggtaaatatagccgttccaaatgggagaaattggccaaaacaaagggattagagggcccatgcaagtctgaaatccagcagggcagtcaattattaaagctccaaaatgatctactttgactccatgtctcacatccaggtcatgctgatgcaagaggtgggttcccatggtcttgggcagctctgcctctgtggccttgcagggtatagtctccctcctggctgctttcacaggctggcattgagtgtctgcggcttttccaggtgcacagtgcaagctgtcagtggatctaccattctggggtctggaggatggtggccctcttctcatagctccactaatcagtgccccagtagggactctgtatggggactccaacaccacatttcccttctgcactgtccaagcagaggttctccatgagggccccatccctgcagcaaacttttgcctggacatccacacgtttccatacatattctgaaatctaggtggaggttcccaaatctcagttcttgactttgtgtaccctcaggctcaatgccatgtggaagctgccaaggcttggggcttccaccctctgaagccatggcctaagctctacgttggcccctttcagccatggctagagcagctgcacagggcaccaaatccctaggctacacacagcacggggacgctgggcctggcccatgaaaccacttttcttcctgggcctccgggcctgtgatgggaggggctgctgtgaaggtctctgacatggcctggagacattttccccatggtcttggggattaacattaggctccttgcttcttatgcaaatttctgcagctggcatgaatttcttctcagaaaatgggtttttcttttctgtcgcatcatcaggctgcaaattttctgaactttatgctctgtttcccttttaaaatggaatgcttttaacagcatctagattaccttttgaatgctttgctccttagaaatttcttctgccagataccctaaatcatctctctcaagttcaaacttccacaaatctctagggcagggacaaaatgccaccagtctctctgctaaaacatagcaagagtcacctttgctccggttcccaacaagttcctcatctctgtctgagaccacctcagcctgaaccttacttttcatatcactatcagcatttttgtcaaagccattcaacaagtgtctaggaggttccaaactttcccacattttcctgtcttcctgtgagccctccaaactgtcccagcctctgcctgttacccagttccaaagttgcgtccacagttttggttatcttttcagcaacaccccactctactggtaccaatttactgtattagtccgttttcatgctgctgataaaaacttacccgagactgggaagaaaaagagatttaattggacttacagttccacatggctggggaggcctcagaatcaaggcgagaggcaaaaggcacttcttacatggctacggtaacagaaaaatgaggaagaagcaaaagcggaaacccgataaacccatcagatctcatgagacttactcactctcacgagaacagcacaggaaagaccggcccctatgattcagttacctccccctgggtccctcccacaacacatggcagttttgggagatacaattcaagttgagatttgggtggggacacagccaaaccatatcagttagttactctcaagggccccacctcctaataccacaacactgggagttaagagcttcaacagatgaatcttgggagaacacaattcagtttataacagatgcaaatcccatcatgagggcctcaccctctaaaggtgctatcttcaaatacaatcacattgggggtagggcttcagcatgaatttgcaggggaacacaattcagtctatagcaccattcaacagccctgaggacacttttgtaaaagccagggcttgtggaaaacttaatttactgtcactgtctcagatcagcccatcttcctggttatttgtttggagtcgggcacagtctttacttacttacacagggttcagactcagtcacctttgccagcttctgctcctttgccctttccccttcaaatcagcccccaagccatattcatacccccattctcacctctagtgccccacccacatcagaggtctagtacatcatgcatgaaatcccttaagcccctctgccagatgaatgatctttaagtgaagcactgtccatatcatatccgctctgaaaactttggtggttctccattagtcacagattcaggccacaccagaggccttaagtgaccttttcaacctgcttttgcagtgcaccccaacatacattctattacatcacctctttattccctgtttttcaagtcctactttagatattgcacctcacaaagaatccactattctttcctgtgtggatatgtctcaataactggacatcaaccattgattatcttgtttggttaggtagttctctcatgtatgcttctatcaatctaaggagattttctattctccataaaaagattagtccataattctttgtatttctctatatagtgtgcttatagttggtgtttacaagttatttcttcattggttattgagttgctgttttcagccccataagtaagctattaatatatgagtaggggagcaaagaaagagaacacatcatttatgtctctttatttagtgaataaaattatacagcaaaatatttgtaagtataaaatgttatggtattagcagtatacactgaagaaatatggaataaaggaatgatgaggtatattaggccctcactactcaaagcttcgtctatagaatagcagctccattgtcactgggcagcttgttagaaatgcaaaatctcacatcacaccccagacctaacgaatccgaatttgcagtttaagaagattcccaggtgattcctttgcacgttaaactttgagtatcattaaattagataactgaatctctgagatcctgctttgtctaatgcttccactgtagtggttgtcaaatggcacccaagattccccggagcaaaacttgaataaccacttgtttgtttcctaattgaaaaataaaagttaattggcagaattttctcatttgtaagttttacactatatttttcttaaatacttggcacctgttacacatttgtctttcctgacacctaacacctcttagtcctggctacacatgagaaccacctaggaagcttttaaaatatacctatatataaccaagccctggccaaggtactctgatttaattggtctggggataggccccaggcatgggcaatttttaaagccacccagatgatttgaatgggatggctagagaaccactaagctagtatgtaaaatgatacatttaaagaatatatatatatatatatatatatatatatatatatatatatatatgtatgtttgccccaaagccatttgtcttttccctatattgctagggagtttcagactaattgatgatttgtcttcatagcagagtttgactaattaatttgaattccagataccatacgtttcttatacagagtcaggctgcttaacctcttattttctaaacatcaaaaaaaaaagtttatattagtcaaagttcaaccagaaaaatagaaccagtaaaagaatatattgagagatttattgttaggacttggcttgggcaattgtattatctagctgggcaggtctagatttgtgggataggctcttaggaagggctgggactctcaggcgtgagctaaggctactgccttaggaagtctcaggaagtagctaaggctactgccttaggaagtctcaggaagtagctaaggctactgcatcaggaagtctcagctctcctcttaaaacctttcaagtgactgaatcaggcccactttagttatctaggatgatctctcttacttgaaatcaactgcttgtggactttcatcacatccacaaaatacctttacagcatcacttagacaattgtttgattaaataactgggaaatgtggcctcaccaagttgaccttttagaacttgtagtcatctattatgtgcaacttgggtctcaaagatacgattgcaaatcactgttgtgccattattagaggcagttgcttctttagagtgaacaggttgaggaaccagattgatgactccccttatctgagaccaccccctttgttgtttaaaaaaaaaatctggatcctaaacagaaatctgtaataaatccaaacatagcattgtttctctttttcagagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccaggtaactgtgaatattagttaacgttccattctggatacttctatacatatatgtgcaaatgtttatttttttaaaaaattatttcttcttcaaagggccattattactatctaatttcttcctccaaggcttctttctttttgtaatcagactcagaagtctttccccattttgaattaaacttatgctgcaccttgttgtcccctcaatctggctgtcccagttcctcaccttccagacttttttctctgatgagtgctttgtgcctgctgccactgctcctagatcccttatgacattagctctgtgtgttctttctgctcttcttactcccttggcttgcctgcaggtagacctggcccatcccttgtgtagtcttccattctctttctcatttctcctttgctcttgacaccatcagttatatcctccttaaaattatgctttcatggtctctgtgacggtccatggtcctgacattttatttgtcaatgtagtgactttttattttgtgccatcctctattttctccctaattatctgttttttctagggcaaagttttctctccacttttagctttatggtctctctctggataagcaagtctatttctctgactcccattgataaatgtgtgcccctgactttttcttgacattaagtcttctatttctacctgtgtgctagacagctatatatggattccctaccgtcacaaaaattctggtgtccaacacagatcttaaaattttcttcctcagaccagtttggtttttcttttatattgttcttgttaccagtgccacttttctcttgctccctatgtctcaaaactacctttgatccttctcctctccctctatatatagtcgccatgtcctgttggtcctaccttttgtcatagctctcattttgatgccatctttcaaaaccttttactgcccaactagtccaagcctttatgactttacacacagactatttgatttagtctcctcactggtctccttgctttcacccacccatttttaatctctccacactcccaaattaatcttgttaaaacacaactcttcctatcatacattctttttcggacactttcagtagtttcttagtcccttaggatgaagggcagttgagtgaatgtggcgcctggggctccccactgttgtcccttaacatgtctctacaaattttgtactttgtgtccactatcactcctttctctggtgtacattctgcactcctgttggttgttcttccatggtcttccatatgtcatgctcagggcaactttcaaaacttttgtcacatcatttcctcatctggcactctctctgaattcccctggcctaacacaaattttactcataatgaaacctagatgaagggccacctcctacatgctttcttttccagctcctccagtccaaattgcctcaccttgcttctttgtattcactaggtacaaggaaacttagagtctccattacctactttttcatttccatatatgctataggatattctttcatatgtgttagttttgcttcatcagattctttaaccacttcctctaaacaaggggatggctgtgtctgtggcttttcttttatatactgtgcgcgcgcacacacacacgcacacatatgcacacacacacacacagcgcccatcatatttgaggcatttcttctgtctgccttctagctctcagtccccactgcaatcagaggctcttctttcttttcttcaatcttgtaaaactttcttggccccaggttgggaatcagatccaaccagaatacactattcaaaagtatctgtccccttagtcagaggttttcctgcaaaagcgatctctttttttccttacattcagtgtatgctgctcaaattgctcacctgggttctgactgcttcactgccaggcaggtatatgaattcctgaccccatgctgcttcttccaccttaattatgccaccacttgtggtttagtcctcattctgttttatttctgtcactatagttattttttgcaggatattacatacttagctgtcatgttcatgtatgtgatattcaagtcactatctccaatccaaatatttggtgatctactttactttttcagctgtttcccaaacacatattcttgggtgtggcattatcaccccaaatctgacttctctagagtccaaccatcattttccttggcatcttctttttctatgactgacctcagtgtacttccagatttctagattcaaaaccttgaaacctgtgttgccttcccacataccacatacattaccctttcattgtagtcttagtcactaaattttgtctgtttcttattacatcgtcttttccatctattcctttcttttcattacctttcagggctaggcctttcaatagctcattgaactcctggaactagccacctaacttctctctttgcccacagtcttgctttcctccggttcttcctacaccctgctgttgaactagctccagatatttctgtccatgtctcctatatgaaaattccaattgatctgggcaagccagatctattctctcagcatttactgtatttatctggctatgtgctcttggatatgctagttcctttctctggaatactcctttctttctttctcatctatgcgagtcttactaatatttcatgatttagatcaaatcactcgtccttctgtaaaattcctgatcactctggcatgtatggtatcttctcccttctctgacatcctaggccttcttacatggatgacaatatcatacattcctgcacagatgctacattttgttaccttgtattgttaatctgcttatctaatattcttgtactcatgacctaactctactacttcatttatatgctttttaaggtgtgtgatgaaaccttatatctgttttggctcttagcacattcctgtatacaatataaagcaagctattatacttgatgaatagcttttggtaaaatatttttttttttcatgaagctatcctagagattgaagaggtcttaatccatttgatctagggctgagtgaaaaagtccatgtttacgaatctaaatcccttcatgattttatggtccatgattgtatatccttttatctttctacagtggagagttttactctttttagtctatgttttcatgcagaagctgtcacccttgataattttattgccttccctaaaccttgggtgcgtattttttccttgaggtgcaaatcgttactgcacacagtataacaggtgcacttagttaaccattattgtagcctattaaaaacacatttagtttgggttctttaattttgtcttttattctttcacttacaggttatttctgacagtcttctgtaaagtttttaagaagaaccaagttgaggggagggattgggggaagctggcatttcatagtcacatcatttttgtgttaagtggaattggatgtggggttttttgtactatttaatacaactaaaacctgattgaattctatttaaagaaataactgcagggtgccttagcctcatgaattatttttcatcacttcagttatgttgaaaatggattttatttatgttaactggtcagaacaattgtgaggacagtatttttgcaaagcattatttagctactaaattatttttttttaagccgctagattccaaggggttttgtggcttgccacatcaaacagtgattatctaaaacatagggtaagagggcagctgatcacccaatgcacttcccacaagtaactctgccaggaggtttttggagaaccccaaggcagaagtattttaataccagggatgaacattttattcagtacatttatacatcttgaagaaacactcagggaatagcgacaggctttgtacacatatcttggacatctttctgcaaatgtcaacccctttagtgtacctcttttaaaatacagctactcgtaggagaggtcagaccatattgagcagtgagagatttattaaagtttagttggcatccagataggtgcaataatttaacattaggtaagttggaataagggttgatgtgctcctagggaaggtgagagtgtcagcagggaggagagagtagaaagtaaccaaaaacattgttctctgacttcctacttggttctggtggccttatgtatgttaccccaaatcagctttctggcttctactgtcacacattcaacatctgatctgaaagaacacatgatgcaatgaaaaaagaaggaaatgtattgacctctaatatgcatgagaggcaaagtttttgatagttcatatatgcatagaactaggacaagtgggtgctggtgttacattttgaatggctgtgttctgcatctgtgaatttgacactattgtacatattacagttggccctccgtatccatgggtcctgcatccacagatccaaacaactgtggattgaaaatattagaataaaactaaaacaacgaacagtataacaataaaaataataccgattttaaaacaatacagtatgacagctatttacatagcatttacgttgtagttagttactaaaagaaacctagagatgatttaaagtatgcaggaggattttggtatctacgagcgtcctggagccagtcctccaaggatactgagggatgactgtatatgcacaaactacctttctgtttgcaaggctgctatttacaagtgtgaatgaggcataaacccctaaagtagcccagtcttacattcttctttgaccttttttacacctcttttgtatttaatatttagattgtcagaatggtgaagaatttaaaaggcagcccaataactctgtcgataggtgatggtgccaatgatgttagtatgatcttggaatcccatgtgggaataggtaagatacatctaatgagatggcagctgtgaaaagtatcagtattgcttttaggtagtgtggtcttacattctagagtgactgttttggttactcatcttgaatttgaattttggaatgataattgttaattaaatggaggcctcatctgatcatgcaacatgtccatcccaaggtcctaccccatggtagaaatgtagcaatgtaacaaagttaaaggatatttttcaattagccaagtagagtgaatttcccaaagctactggcagcacaattgattgtttagctcttactttgacagcatgcatgaaatttttattgattttctgcccctggccagactgcctgcttatgttgctgtactatatcttttgacatctcaactgtttggggctaagaaatgataattggttggctgtttttcaacatggcagtattaatgggtggtttgggctgtagtgttgaatttatatattgacatgcaacaacagcttttccaccacctgtaccattttttttcccttctctggttgctattaggcaacacaactaactccccagcaagttagttagctagtttgtttgttttggcagggtggtggggccagatatggaattcatatcttgggaattattgtactgcagtttaggttcccaaactgttcttttcatttggaagtattcctatttcttgtgcaacttgaagtactactcattggttatccaagtgtcaaatggcctaaagctgctcgagctcatagaacccttgcgctgctagtcagggtttcatacatgaaagaatttcaccgtcttctcattgaactcctagaccacaaaccccaggtttctgagttcccttaatatagcacctagtctagcgtcatacacaattaagcacttactgagtgacttaattatttttaagttgagtttttttcttcagataatttttaccttgtaatgattgaaataatgattctatttaattgttgtatactgtattacgaatagggagttaccagttaaacttagttaaattatttggtaagtctcagtgtcactgttaaagaaagctcttttggtttttaaaaaaggaaaactaattgatagaattgaactataacattaaaccaagttgaaactgtgaagataaatcagggagtcatttattctagaaaatgctcaccatatagagatactctcttttaggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataaggtatgtgataaaatatatgtaatttaatttctttttaatccagcattggctcagcttggtcatggttttgttcttccttttttttttttaatgctgcttttgatatctcatactgaaatttgcagtcaacaaagcagaggtggtctattggatgaatcagaaaccagaaatgccttttgatgcaaaatttttgataggaatttttaagccctccttattgaaatgtaaattaaatacaataaagtgtattcatcaaaagtgtacagttccatgagttttgccaaatgtatacatccatgtaaccattacaccaatcaaaaaatagaacattttggcttggtagtggctcattcctgtaatcctagtgcttttggaggccaaggcgggaggatcacttgaggtcaggattttgagaccagcctgggcaataatatgagaccttgtctctacaaaaataaaaattttctaaaatgaaatttttgcagtcatttctaattgtctataagcatgtcaaccaagagaaccagtggtaacactttgatatgtgaccttgctggtcttttgtctgtacaaattaacatatgtactttttttatacttttatacactatacactacattgaggtttttacaatttttttgagatataatttaacaaaattcacctttttttaaagaaaaattttcttaaagacagagtctcactctgttgctcaggctggagtgcagtggcgcgatctcggctcactgtagcctctgcctcctgggttcaaatgatgctcatgcctcagcttcccgagtagcacatgccaccacacctggctgatttttgtgtttttaatagagacagggtttcaccatgttggccaggccggcctcaaactcctgacctcaagtgatctgcccccctcagcctctcaaagtgctgggattacaagcttgagccaccatgcttggcctaaaattcaccattttaaagtgtataattcagttacttataatgtgttcactatgatgtgcaaccatcatcattgtctaattctaaaacttttctatcatttccaaaagaaaccttgtacgtattggtataatacatattgctttgcactttgcctttttcacttaatttatgttgtgaacatttttctcacccaatttaatattcttccaaaacatgataattgtgcaacattgcaaatccccaatattggacactgaagtagtttcctcaacaataccttggtttccgttttatcaccaagcattagcgtatacgttagactgagtctgcatacttgttattgtctaccagggaatagaatttaccaaatttcttaattagattctagtttgtaggtagagtatttagtgcatcttccaactactcaaatcatatagtatttagtatataattcaagtagttatgatatttgaatttcataccctatattttataagagttaaagctcagcacctgattttgtgtgtcagttgtctatagtcaaccctaggtctttcttactaactttatatttaaagaaaatacatatttataaaactatgaacccagtttcacaaattttctaagaccctggtagccagtatctgctggtagccaggccaaacactgtggaggaggaaaatgatgataatgatgatggtaacccaatatgtgtaaggtattttgtgagttcacaaaatcactttttaaaaaatgtaatcctcacaaacatcctatgagtcaagtagtagtatctccatttaaaatacatggaaagtagagctcagagagatggtataacttgcctttggctttccatccaggaggtgacagagctagatgttccaccatagattcatttactccaaatccaggactttttatgtgtcacagttagggtcttttgggccttgcacccagtaacagcagctcatggaaataaagggttattctctcttgaccttcacctagtaggagatcccttgaagatttgtcatacagatctgcctagtaatctgaacctatttcagaggcttattttgcctcttttgagttttggcctgcaatttaagcaactgccaccagatggaaggaatgctctgttaaggagagcaaaacaagcgttaaaatggcaaatgttgaccagtggttatttatgtagatgatatcctctgtcttcgttagtatctctaggcccattatcatcttggttactgactcagcagtatttcttttttattactatcttttgtgcgaagaggatttctaaaattttcaactctatttggctgagctgagaagtctttccatcctctcgccattgcatcttcaaattgttattgcccactcccggagtacttcagtgacaggtcttcctgccttctgtttctccatttaatcctccttacataattcaactagattagtgtttaaagaatgccacttttcaacttgtcccttagaacctttactctccaccgtctcagctttagtctggcttttaatgcaccccacagtgtgaccctgtcttaccatataagtttaaaatatatacattcttgccttggttcctgccatcaacatgtcctattcatctttattcatagttcgagttctaagttgtttattcaatcggtgaacaaatatattttaaatgtgttaccatgtgccaaggcctgttttaggtgcttgaggatacaccatggaataagacaggcagtgtcccttttctcatgagacttacattctggtgggtgaggtagatacctgctctcccttctcaatggagcatccccatgatccccactgagctctacctgcttcaacctcagaacacttatttttttcataaactgtgactctaggaatactatggactatattttgcattgtaccagaactgataatgtataaatgagtgttgcttttccaggtgatgaccttgggagctctgactcatgctgcaggggcaattcaaaacctgttgagctcatttctttagaaacatcctccagagccagtagtacattgatcgaaatatcctcagctgtggtagatgttcatcttttgaggttgcatttgatttttaaaaacagtctcaagtctcctagagctaattctggagaaattagctgacagaagggaggagactggttttctggcatgactggaaagtgggctcttgaaggggcttcttgaagagaagttcagagacatcatgaccaagtaacagtaaaaaagctcacagcctgctttgaaggatagcacttatttgaaaattctcgtgctggtagttttgcttaaagacattactttcagtattttataatcacacttagtagcttttactaccttatgaattcccagcttgtgtttcttttctgcttgtctttttagtatttctcaaattaaataataagtcccttaggacagtggtccccaacctttttggcaccagagacctcgggccctaatgctcacttgcctgccactcacctcctgctgtgcagcctcgggggaggggcgggggagccctgacttaggaaaaagaagttgactctttttttgttatcatctgtgtgccacctttgtgtgtagtagatgctcagtaatgatatgttgattgtttgatgaggtagtaataaaggcattaaagcgttagttgatattgttagtgtcaacataatctataataatttcccaactatttattggcattaattgactttaaatgtacacttacagcattgtcagtctactatatgatttgcaaatctaattggtgttaaagatacagtatcattaggtgttcatattggaggagctcatttatttcctggaagaaggacagcaacagattctcataaagtaaataagatcctcttctgccttgatagggcaaaagttggccttaatatgaattaatcattgttttagttgtttccttatgtctgtggaatagaggtttattgcattctgacattagaaggatttaggaataattataaactatttggaatatagtttcccattttagtttagcaagttgattaagtgaaaatgttaatccttgtcttaatttttttttttcagaacctttgtttcattttgccacagtttttgtaccagttcttctgtggattctcacaacaggtttgtttctcaagttattcgttataatatagtttacatttgctgttaataaattacccttatatattagatttctagagattagagatgtatgtacaaagtaaaatgatctcttggttttgacaacagcaaatgtttatgtctttgcttttctagttttcttattgttaccttcattttgaaatgcttttggtacatcctgttggagttgtgataacattaaaaagagtattttgaattttttctttttatcaatgtataaaaagtgtttcataattctaaaatgttatagtttaatatttcatcaaatggaatctcccaactttgcaggctttcaggttagttttatagaaaagcattaatctttaagctagccaagaacctgtgattcctagagaaagctttggattacgtaaagcagctatagatgttttgccttctattgttttctgaacatgtattacataaggaatatgctatatattaacttgatacataagtggtaggatggcgagacatctttgttttaaaaactgaaatggatttggcattgcttctagtgggaggtatagcgaaatacagcgaaatacaggagctatagtactcagtgactcagaaattttataattaatctatgagaagttcagtgattttgccaaactgagctaccacattgccataggtgttaagtttctaaatttcaaaggcaagctttatatatgcttctgtgaatacaaagtacacttatgaatacacttatgtattcttcttgggtcctcctggtaggaagtgattttttcctaattctttggcagttttttttttttttttttttttttacttttaggttcaggagtgcatgtgcaggtttatgtaggtaaactcatgccacaggagtttggtgttcagtttattttgtcacccaggtaaaaagtatagtacctgataggtagctttttgatcctctccctcctctcactctccaccctgaagtagactccagtgtctgttgttcccttctttgtgtccatatgttctcattgtttagctcccacttataagttagaatatgctgtatttggttttctgtttttgtgttagtttgcttaggatgatggcttccagctccatccgtgttgctgcaaatgacatgatcttattttttatggttgcatagtatttaatggtatatatgtaccacattttctttatccagtctaccattgatgggaatttaggttgattacatatctttgatattatgaagaatgctgcagtaaacgtgtatatgtgtctttatggtagaataatttatattcctttgggtatatacccagtaatgggattgctgggttgaatggtaattctgttttaaggtctttgaggaatcatcacactgctctccacaatggctaaactaatttacattctcaccagcattctgcaagtgttcccttttctctgcaaccttgccagcatctgttacttttttgactttttaataatagccattctgactggtgtgagatggtatctcgtttttgttttgatttgcatttctctaatgattagtgatgttgagcgttttttcatatgcttgttggctgcgtgtatgtcttttgaaaagtgtctgttcgtgtcctttgcccactttttaatggggtggtttgatttttgcttataaatttatgtaagttccttacagatgctggatattacatatttgtcacattcatcatttgtaaatattttctcccattttgtaggttgtcagtttactctgttgatagtcatcttcttgtatgcagaaattctttatttaattaggtaacatttgtcagtttttgtttttgttgctattgctttcagcatctttgcgatgaaatctttgccagctcctgtgtccagactggtatatcctaggttatcttccagggtggttatagttttaggttttacatttaagtctttaatccatcttgagttgatttttgtatatggcataagaaacgggtccagtttcaatcttctgcatgtggctagcaagttatcctagtgccatttattgaatagggattcttttccccattgcttgtttctgtcagctatgttgaagatcacatggtcatagatatgtggccttttttccgggctctctattctgttccattggtctgtttttgtatcagtaccatgcggttttggttactgtagcctgtagtatagtttgaagtcaggtattgtaatgcctccagctttgttcattttgcttaggattgccttggctatttgggctcttttttggtgccatatgaatattaaaatatttatttctaattctgtgaagaatgtaattagtagtttgataggaatagcattgaacttgtaaattgcctggggcaatatgaccattttaacaatattgattcttcctatccaagagcatggaatgtttttccatttgtttgtgtcatctctgatttctttgagcagtgttttgcaattttcattgtaaagatctttcacctcactggttagctgtatttctaggcatttcattatttttgtggctgttgtgaatgggattatgttactgatttggctctcagcttggatgttgttggtgtataggattgctactgatttttgtacattgatttcgtatcctgaaacttcgctgaagttatcaggtcaaggagcttttggggcaagactatgaggttttctagatatagaatcatattgtctgcaaacagggatagtttgacttgctgtcttcctatttggatgccttttatttctttctcttgcctgattgctttggctaggacttccagtactatgttaaataggagtggtgagagagggcatcctagtcttctggtttttgagggaatgcttccagcttttgattgttaagtgtgatgttggctatgggtttttcttagatggctcttattattttgaagaatgttctttcagtgcctcgtttgttgagagtttttaacatgatggattttattgaaaaccttttctgcatctattgagatgatcatgtggtttttgtttttagttctgtttatgtgataaatcacatttattgatttgcagatattgaaccaaccttgcattctagtgataaagcctgcctgatcatggtggattagctttgtgatgtgctgctggtttcagtttgctagtattttgttgagtatttttgcatctatcttcttcatcaaggatattggcctgaagttttctttttgttgttgttgttgtgtctgtgccaaggtttccgtatcagaatgatgctggcctgatagaatgatttagggaggagtccctccttctcaatttttttggaatagtttcagtaggaatgctacagatcttccttatacatctggtagaatttggctgtgactccatctggtcctgagctttttttttggttggtatactttttattacctttcagtttttgaagtcattattggtcttttcagggattcaggaaatctctggttttctgactggttcagtcttgggaggttgtatatgtccagaaatttaaccatttcttataggttttctagtttgtatgcatagaaatgttcatagtagtctctcagggtttttgtatttctgttgtatctgtagtatcatctgctttgtcatttctgattgtgtttatttgaattttctcttttttttctgtattagtccagctaatggtctatgtatattattacattttttcaaataaccatctcctggatttcttggtcttttgtatggtttttttgcatctcagtttccctcagttcagctctgatttgggttatttcttgttttcttctagctttggggttggtttgctcttgtttctgtagttcctctagttgtgatgttgggttgttaatttgacctctttctaacttctttctttggtttccttttcttcttcttttcttccctttccctttccctttcttttctttctttttctcttgctctgtcacccaggctgtaatgcagtggcgtgatttcggctcactgccacctccacctcctgggttcaggtgatttctcctgcctcagcctcccaagtagctgagattacaggtgcctgtcaccacacctggctaatttttgtattttattagagatagggtttcagcatgttggtcaggccggtcttgaactcctgacctcagatgatctgcctgtgttggcctcccaaattgctgggattacaggcttcagccactgtgcccggccctctttttaactttttgatgcgggtgtttagtgctataaatttccctcttaacacttccttagctgtgtcccagagattctggtatgttgtatctttgttcttcattagttttaaagaaattcttgatttttgccttaatttcattatttacccaaaaatcattcaggagcaggttgtttaatttccatgttgttgtatggttttgagtgattttcttagtattcatttctatttttatcactctgtggtttgagagtatggttggtatgatttttgtttttttgaatttgctgtggattgttatgtccaattgtgtggtcgattttagagtatgtgccatgtggtgataagaggaatgtatattctgttgttttgggggtagagagttctgtagatgtctgttaggtccatttggtcacatgttgaattcagggcctgaatatctttgttaatttttggcctcagtgatctgtctcatactgccagtagggtgttgaagtctctttggcagtatttttaagagaatgcattcttctcaatgggaatgactggtctctttctcttgaatttgcctttttactatttggtatgctgtctcttacatcagtgccatgtcattagcccagtagtgccagttaagcagataatctttcattataaattaagcatcttgcagtttttggaagtgccatcaaccttcttgtattcaaaattaatagtattagagagtttcgtaagttctgatcaatctgtttttcttgaacattcaaattgctattgagcaaaatgttgctaattccttactttcttggatggatgcaagtattaaaagtatatttgaaattctcttaactaatgtgtagcagtgtgctaaaggtaagttggcttgttctggtggaaatattgttttcattttgaaaggagtctgttgctgtattatccttttaaaatatgtttaccaagcacaaattttaggggaaaaaggactcattccttacaaagccagctgagatttaaaccgtggattgtcttcagtcttcttagattaccttaactgcttatggttccataggagttgatgtttggctccttccgttgctcaactggtaggttcattcatttggcaactatttcttgattgcctactttgtgccaggctaagtgctgagaatattgcagtgatcaaaataaacttccttgcccccatgaaacttgcagtgtgtagtgatagggtgaaagacaacaatcaaatatattatgttgggtactgatacatgctatgatggaaaaaagaaagcataataaagggatagagtgtgactgggagagagagagctgccgttttagacatctgaaaaggtctctctgatgaggtgacatttgggcagagacctggaggtaagggaaggaataacgtcgacatcttaaaggaaaagtgtaccaggtaaaaggaaggtaaaagagtaccaggagagctcaggaggtaatgtgatgtgcaaaatctttatttttgattttggttttgtgctagtgctgaatgtagcaacctttattgcaaatatctttggagtacctttgagtagtcagcctttttcagtccagaagcacattaggcattctctggaacttgcgaggaggactatgaagaatgtagaaatggaccaggattcagattctttacacaaaaagcttccctttctttagcaaaactaggatactaaatgtcttttttttttttttaatgaaaaggaaacattgtaacaggtttcataaaaaagcagtattatcaactttatctgtttgttttggggatattctgtctcttctaattatgtacctaagaattacaattatctgtcatgtgattttaaagtaccatagtgaaacaaaagtagattgatgcttcttttgtttgaatgaaattcaagactaaatgacacaccagtcaatctgagttgtattttttaaatttactcattagtgaaaatgagtagcttccaaagaaaatgtggtgttatgtgccacggactagtcctctcctttgaaaataaaaaggaatgcaacacttttttttgtacttcttaattcagtggaatatctttgctgagcttaaatctttgtttatagaaagtacgttggaagtgtcttttaacttcatggagaatgttgcatccattatcatttgctttgtctctcctgccagccagagttgtagtcccctcctctgggtttccccagctccctgtgtacctctcattctgcctctccatctagaatttgaactccctggtggataggggaggaatcgtctctgtccctagtacttgtcatttagtaggcactcggtaaatgttctgaagtcaactagtgaactaactaatgcaccattcaagtaattcccagccttttgtaattatctttagtagccattgattgaaaatacattattttgttaatttgtgtcatagtttaatgcattttattaagggacatttatacatgtgaaaaatacatatgagtatggggaattatttattcaggccacagaaaatgtttgtttgacaatctttagcactgtgtagataaatactgatgtaaatgctttcatcagaatgaggttcatagaatactttaaattttttcaataaaggaagatttataatatcagagcaggcctttataaatgttatagcttccgatctatcctcattcatttattcatctagtgtttattgattgtttttgtatgccaagtcctgttataggagctcaagattgtccaagttctccagtcaaagacccccatgaacacacttgtagttgatcaaattaggtttattactcagttcaggaaggaagaacacatgccatgaggaactgtgggacttctcaggaagaggatgttagaaaagacttacacaatttggacttgaaaatactaaccaaaaatatgtaaaatattaaccaaaacatttgtgacacaggctggctgctgcctgtatttagtttctctgaggattcctcacttatacttaatggtctttgctgaagtaactccagaatagctagttttagctactaagcaatcttgaaaagttgttcatgtctattagaaatgcagcttatagcatgtaaacattctgaataagattctgttaaaggggaggtgtattaatgtgacacatcacaatatgttagtttcttttttatagttactaggcagtgaccttatttacagattcctttgccactaccaaaagcatgtaaaaaaatttcttattttagctagtaagtttttcacatacataagtatcatcttgtagatgattgttacatgaaatttctttctttcctctgttgtttttcattttagccactgtatgatgctgcttaccttacaatgtacaatatctgcttcacatccttgcccatcctggcctatagtctactggaacagcacatcaacattgacactctgacctcagatccccgattgtatatgtaagttaaatatatagttaaaaccccctaagactttcagtgttgtgattttcattttatctgcagatgggaagaacacagaactgtgcacttggtttgtggtatgattatatggttctgtttggaatttttagctattgaaagcagactgctcaacaggaaaatgacatatttcctaggtgtgggttctgtacttgaatatatgtgaaacatttagttcagagtcactaattcctaaaacttgaaactatattgtcatagtgttctagtgtctcatgggaagacatgatattttaactgcaaagaaaaaaagcatacacaaagatcttctgtagtttagaatattgattcctacttgttgtagattgaactgatgaagttatattaccctttctcatgtaaactgcacccatagcattagccgccccacaccccacctttgttagccccattctaaaactgttgaagaaaataatggactcataagccattgtattcattttgtgtcagttgaaaatggatgcttttctctgtggatgggggacttggcactagccccagttgtttaacttatgatttaattggatttttagaattgtagcctacagctaaggataaagatattaatttatagcagattgtaagcattgctaaatagtaggtagcaagtgcaatagagaggtttggatggtttatttgtatgaaatgaagatacacaaatttaagggattttttttaaccagcatgactcataaaatttacatttagcaattgttagaattacacagttgtgaaatttatcattttaaaggtctttattaaggaaaatttcagacatacataaaagtagagagaatgctatttatataatgaatgaatgtaaatagttgttgaaccactcagcttgtcctaaccactcagcttcaacaactctcaattccttgacattcctattccactgataaccccgtctgctctatcacaggcttattttgaagtaaatctcaaaaacagttatttcattatgcatctcttaaagacaaggatttttaaaaataataataccctatcacttaagtccttaatatcaaatagtcaatggtcacatttctccagttgactcatttcttttcatagcatgcttatttgaatcaggatctaaagaaggtccacacattgcaattggtttatatactttctgagtctcttttaatgtttaggttaaccttgcaatttatttgtggacaaaaccagattatttatgttgtaaaatttctcccagtctagagtttgctgattgcatcttcatggtgtttacatgttctgctgatcctatatttgttgtaaatgcataattagatgtagaggagaatcattagaactttggtagaaatcttacaagcatcagctcctactacactctttttgaaaataaggaaccagggccccgaaatgacttacctaaggacacagggtacaaccagatgcaaaatgaagatcagaattcaaccctcttgccagtgctttttccagcaagccagtggttttaaaacattgttttaactgtagttgtttccagacaacttctaaagtgaagcccgatagtgcagttgctctggttgaaatggggtttgaggagtagtaggcagaattcctcccattccgtcccaccaagagctcagactaacacctgggctgaaagcctctgctacttaccaggtgaccttacccaggttactgcaatgtgcctcagtttcaccttcagtaatacatgggcaacagtagcacctaatcacaatggttttgtgaggagtaaatgagccactatgtattaaagaacttaaaaaaaatagtgcctgacaagttttcaagcaatgatagctattaatcttattattattctaacaccctcctccagccttcagagctgtgctgaacacttgtataaattaagaatgtgaaaaatctgcaaaaagctgttgagtacaaaatatcataagggtttccataaggttttagtgactgtgctaggtgtaggtcatgatttattgaattttgcgtagacttgccacatctgatgcaaaaataaaggccatggcatacctattgccgagcccaaagtgcggctttcctttttgatctcatacttgcaagttgtgaatgcctgctctgacaagacactgctcttggcctgtcaccagactgtagatagtttcattactctgactgttcttttgtgaacatgaagccctggtcttcctatatggctctctgtacagtatgccaattaatattagcagtggcgttgtgtagtgtattatagattttacctttggtgatttagtgacttgggtattaccaaacacttggatgtgagatgacataattggatgcttttatatttttaagagaaatgtaagaaataaactagtttttctatagagggaacaggtgtaatttgtttcttctacagctttaaaaggcaaaagaaagggttctggtatacctgctgcctaccataatacggaggtgctcaggcctttgctgctcatcaacctctccccagatcttgattctctctcatgctgtccttcatgttgattgccccattctgagtttttgacagcttctttattcgaatgcagctagaaagcctgacctataattcaacatatcatgctgctcctgctcttttcccccactgaatgtgatataattcccatcgatggtctgtaaagacaggaactacttcctgcttttgccctttcttccccagcccaagtcagtgactgtcaaaagccacattggctggcagttgttgggcactgcctgcaaggatctttacggaggtgccttacctgtggttcctagttgccttggaaacatgacttactggctatagggagagcttgtttctgggaagcagctacctcattctgccatttttctaggacagagagcataccctgagtttcagatcgctgcatgtacctggaaaccctagtaggtagaagttgcataattgccatgtgcacgaagccccacagtacccaataccaactgaacaaggattagttgcatttatattacaaaggtgtttcttacttgatacagcccagtgacattcttggtagtattagcgacaagtatgttatttgagtaattagatatcatttattaaatgttaagagcaatttgaaatagaatccaaaagaaacacatgcaccaacccatctttttctgcagctctgctccattagaattggtagccttatttagcgttctgacttaggctgagaaggttgtgctatttttgacagatttaaacttaatctatccacctcccatttatcaaagtatcattatacaactgcaaacatgttatttgacttgatggaaaaatataaagggcaccgtaagacctaaaaaaaggtgaaatttccaggagtaaatcttgattaaaataaatattgtaattgttcttggaaagcttggtagcttggttgagagcatatgctctgaagtcaagtcaatccaggattgtatattagctcagtctgttaccaagtgaactttggcacggctgctacactagtggttcccagactatactgcacattgaaatcaactggtgggctttaaaaatatcctgacctccaggttataccttatgccaattaaatcagaataaagatggcagccaggcattagtagtttttaatgatcctcaggggattccaaagtgcatcaaagtttgggtaccattgtgttacacctttctgaggctccttattattagcaaatgtgagtggtagtaatacctatctcatgtttttatgtggataaaaataatgtctgtaaaactgtgaacccagttcctggtatataagtaccattaaatggaagcgaattattattgatgttattgttgtcagtgaccaaaaatttggaagagtttagagagtttactccagtggctgagtcaggagatgattgcatgaaggtcagcctttggctcagtctgaccctttaccaaaaatctgtcaggccattaagggtagcccccttcattataacagggtcaaattccacgcccacctttgacatttcactgtatgtttaaatgaaaagtttcactaatggttttttccccccatttctcaataggaaaatttctggcaatgccatgctacagttgggccccttcttatattggacatttctggctgcctttgaagggacagtgttcttctttgggacttactttctttttcagactgcatccctagaagaaaatggaaaggtaaaaagaacctgtcattacatcttttggtattataagcatggcttgtctttttcccataggtgctggatttgtcatatacatactctagctgtaatcattttacaaactttttctgaagatacagtagttagttctcacagcttctttagaacaatagaagtgaaataagaaatcactttctgtgcatggctaactagagagcttatgtgcaaactttctggaaccttaacttggctgtaatttttactagatgaacagagttcttgggacttcagactcctgctctttgatgtgagaaaggtttttcccattttaaagtaaagcctggccgcattcagtttttactcatagtggccttccatgcttggagctgaagcgggtagctgccatatctttggagtgttggcccaatatgtgaagagaggaattctcttctctccctcctcttcccaatggaagcacagtattctgcagaaaggctattctggtcctgccagtgtcttcccagaacatgactatctcattcagcagttgcactggggtaattttgccctggctgtactctaggagaaaattactgatggcggggacagctgaggcctttttctgcagccacacaataggaaaacaaaaacactaccttgcatactgctttcactaagttctcctttgctatttctgagattcttcttttatggtcattcattctttataatcataatgtgaaggaaagctaaggttcaaaaagaatttactgaggatactatgtctggaacctggtaacacctgttacagaagtaataggttcagtgaatttgaatggtactttaaaattaggcactacagtcaaaacctctctaatttggactaacaaaaatcagtttagtatgaatccatgaaaattattaatcataaagtacttgttggggaaacacagatctgctttaaagtagtcacatgtagaacttgccaaagagaatgtcctgctaaatcctgtgagtacttgggaaaatcacatcagtttcccaggtcagttttgcccatcagtaagaagaatggatttgattttatgatttcctggcctcttcagatttataactgattgtgcagctttcactttttatgttagttttatttggcagacagattttatgtagctggctactgcttaaaaggagtttgctccaaagtaggcagatactctcctatagtcgatgtgattcatttgctcagcaaactttccaggtggtgcatgagagcatcaattcagcgtctgtttaattcattacccattttgagttcataaagtccaaattaataaggttttactgtatatgtcaccatccctctaaatgtttgctgaaattacagtaagtgtatgaattacttttagcaacaaaacataacactcatgtatgatttgagtgaatccttttttttgcttctattaaccttaatttttgtttttatttttttgaaaaaaccttttacatctcattttctgttttaatgttacgcattcagatcttgacagcatttggtaagcatatgtgccattcattgccatcatttggatttatacatggtatctgcttttttttttgatgtgcacatgctgatagctcttgtatttacagccaaaaaaatcagactcatttaaaaaatgtgaatccatttgtctataaattactgctcatttgagaggtttagttctatattataggaaaatcccatatcaaattctttagagacatgaatcatccaaatgacttgttttgatgaacattgctgttagtagagtagttgccttctttggcctttatcacaacagtgagttccctcttcagtgctgcatggagtaatagaaataaaccctaccagccacaggtgtggtgtacctttttgtgaaaattggatcacaggaaaatctggcattgtggcctgatcttactgactagctgtttccctaaacaattcatacaaaaatatttggcacttacacacaggattcaacttggctttttttttaaatgaaaaaatactaagataatacttgtatatacatggtacatgtaattattaaatgtttttcaggtatacggaaactggacttttggaaccattgtttttacagtcttagtattcactgtaaccctgaaggttagatttttacttattcatgtattttttaatactgtttttataatactttcttgtcttatcctaatataccatttttttgtctcctttatttcttgttatgggttgttattcaagtgtttgccttaatacttactaaaatgtgtatgatactagggatttgggtatttgtatactattttttgatcagttttttccccagtatatcgtaatcctctttatattgttttacttaaaaaaattcaaacaccatacttatgtcgaaaatctgtttcttctttattgctgtttttaaggcgttatgataagtggcatataaacaggctgtgggtgagagtgagagagagagcgagagagagagagagagtgtgtgtgtgtgtgtgattatgttaagtacttgaatcttctaaaaattatacttctgtttaagaaccccaggcctaaaataggtatatatgagcaagataatatgtgaaaaagagcttggtagtagtgaaatcttataaaatgttttcatcactgatggccaggttggtggctcatgcctataatcccagcactttgggagaccaaggtgggcagatcgcttgagcccaggagttcaagaccagcctgggcaacatagcaagaccctgtctctatttttatatatatatatatatatatatatatatatatatatttttttttttttaatttaaaaataaatataaaaaaataaaaatatataaaatgtattcatcattaaaatttacccatgttagtgataaagtgcctaagaatataatgcaggtaaacaaaagggaggtaattttggcaaaatcattggcattgacatgcagccatgtgataatgctgtgaagcctcactgaatgctacccttgaggcccatgatttgggaatctcttatagttgaaagcataatcaaattatttttgtcattccaataataaacacctcacatgggttccatgagtaaatacctttaaatgaattctggcatgcccaggggttagaagcagaattcagaagtataattgtcaaaggatctctcttacctttccctctaaatttttgttcctggtttatttcttataccagatagagctaacatatgtttgctttattcatctatttcagtaacattttaggaccttaaaaggacattacaattcatctcagtatagccacttactagctgtgtgtccttcggcaagtaactttacctctctgtgcctcactttcctcttctataaaatcgagatagaagtagcacctaccctttttgaggactcaattagtgaataaagcacttaggagggtgctcatttcaatatatgctagttttcggtttttattatgtctcacagtatcacaatttgaaatggacgcctcccccctccttttttcccctggccttgcatatagccacagggcttccaaatggccttcacagtgtttttcaagtgtatctcaaagacttccactccctcctctttggattaatattagtattatctttggattcatattagtattttccttagcaaccagaagaatagcaattcaagactgagctacattaataatgttatcaacatcctgtttataaatgagaaactataacagagagctgatgaccatggtgtcacagcaagtaacaaaactgagacaccatctcctctataaaaattaactgctctggatattagctcatgtgacccagaagttttaagcaagcgaaatagtccatacttttgtttttagatcacatttgaaaaccccagataccacaatctgaaaacatgattggtcctggcagaaacatgaagagattaaaatctaactgaatattttattaatttaatggactagatacaggttttgcaattggaaagatacactacatagtcaaacccatgattcattgctacatgatgttagatgtatagagcctttgcatttagtgactcccgtctgttgtgtttgagctttcacgacacctttgaaagttttgtagtttgtctacccttcctagctaccccttccctctcctacttcttttcagcttatctgcccccaccagctaggtctccttttgccatcatcttcctggctgccattgcctgaggacttggggcttgggcctcctagatattaccattacttcattccttgcccattccccagtactgagatatctgcagccctacacctactagctacttagcctgatcacacctccagcctgtacgccagtttagaggccttagggcagagctcagctttctcacccttgttctttgaaaaacctgggttctgtttagttcccctcttctctggatccctggcccaagctagatcctttcataggtatcattgtgtactagttatcagatactatagcgtattgcctggtgcaattcgtaaccgtcgtgaaatcttttgtgttgtatcttttcagcttgccttggatacccgattctggacgtggataaatcactttgtgatttggggttctttagccttctatgtatttttctcattcttctggggaggaattatttggtaagcaattgtacatgtgtgagcaatatgtaaatagcaaagtagatacatgtgtatgtacactatatatgtaagcattcattatactttaaaaattttaattatataagatgacacgtctttaatattaatggcctgaaggttatttgttagctggtagtgctactaatttcaggtaagattttaaatacacatatatagactgcacaagtcactcagaagacctccctttggtagcttctgtctgtttgaaggtgttgtaaacatctctctagtgaaactatagttttcagcacaacctctcgtgattttcagaggaaatactcatcctgtgaagtttctacctgatatattgaccaacagatacattattgtccatttggacccttattttctcttgatagtatataaccatgattcatgttactacaggtgtgctcagggtataggatatatacaacttaataattcagagggttgtattttgaaattgtcatcttactgttttggtggaggagggaagatgtagaaaggcagactctgcagcttgtctttaaagttcatttagttcatcttggttcagtagatagatgtttgttcagaatcagttttgtgcttgagactctatgggttagagagatgactagactgtactcaaggagaatagagtccagtgagggacacataagctgtgattgggagagttatatatttgcatctcctttctttactcccaaaaacatatattttatttttaaatgtcagagttgttttttttagtgaatggcttcccctgacaaggatgccagcagcagagagcatggctagagcaagccatagtgtaagatttcaggagtacatattttcattgctttgagcaaaatcttacatacaaaatgattctattttatcacagagatgtgaggcttatgtttatgtcccttgagtcttaattagaagaaactctattttgaaaagctttttaaaaataaaaaccttaagaaataaaaatatgagaaacctaatcatttaaggaagtaccagctttaaaaagtataattacagcatatatttggtacctctataggtaattgagagcaatgaagctggaagaagtctctattttctttaataatataacaaataattcaaagttgattaagaacataccatatacaattgtatgtctgcccagagtaccataattctatgaatctatgtaatcagcatctgaactaattatgcaaaatttctacaaaaataaaatgtttccagcgaactcatttccaaccctttctacagactattccttattgatgaaaataaatccagtaaatgattatggtattgtcacacctgtttattcattagtgctactaaaaatgaaatgttaatctattttttattttattgcctgaagtattatcattaagtagagttgagccactgcatgaatataaacttataaagcaaccagtaaaatgtgactagaaacaatgtgaaacttcagctgaatgtggtcacaactgatgtctctagacatgttttaccctgaggcattgagtcacacccgtctttggggttgggtagtgagaatgatgacttccgagccccaaaccacatccagaaataatagtgtttattttttactgccctactacaaaactccatagatgacatggaggttaaaaaaaaaaaacaaaaaacaactggatgcattagtcagaaggtatgatgccaaggaacactctgtgactagctgccatttgtcatctgggcccctgttatggctcagttaactgcctagaacattattcaaggtgttcttcagaatttgagtgaggtagagttctgcagaagtcttttccatgtggcagacttttcccagaaagcctgtgtagcctaggcctcataaatttttctaccttcctgttctcacttttattccacaatctaattttcataaaagtagagccacaaactcagttttatcatgttacataagggtgcatagacattaatttttaaatgagaaaccaaattatcttcaggaagcatgatgtgtcatctaataaacaggagccatggttatctacctggagctctttaatcctagggcagtctgatgtgcatcctgtctttaagcaaccacttcttccccctcaccttcaaagaacaatagcttcacctactgaggctctctgtggttcagctcagacagaagggaagggaaacaggctgtgcttctcaatggccactttacaatgaagtggatgactcagaatgaaatctaactccagaatgggggttcctgctggatttctggattctaaggcttaatgtccaattagcaatattctactctgtgtcaacctatttggcacatactgttaatatatatttgtggatgacaatggtagattccttccatttgagagagatgataagcttctactgtcctttttatatttacatagtgtttttattgggagagagttataaaaatgtcttttgaatttctgaatacagaacacaaatccatccccatcttaataaaacagctgaggaaataaaatgcttgttaggataaaaatgaaccatttctcttgaatatcttttaagcaccagcattttctaatgcacataaatagtcgccagttggcagctttagaattgattgcctgattgtcttcaagtcaaatgcattttatcttttttctcctttgattatcattcctttttttccaaacatttggtaaatgaaatttgtttattactttgggatattctagagaaaattatttttattaatgtatgtaaggaagattctttttaaatacaaacgacattttaattaaatgtccatttcatatgacaggaattgatttgtttttccatcatgtattttctttccactgcaggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggtaagaactaagtttatcttacaacctgatttttggaaggggcctcaatatctgccatgagctaaaaacctgatttagaaaattacattagttacagcatgttaaacccctccttacaggttcatcacttaatttcctcttctgcataaaaagtatagtaaaaacttcgttatccaatgcaggtggtaagtagattccttaatagtgttctatgtgaccttcggcaatccatatggagtatctcatatgctccatatggaattttaaaaggaaaaaattattttattttgtatttagcctagaattttcacaccaggaatttccacaccaacattttcgctttaaacttagaaatttccctgtgggctgtttgcagatttttttcagttgataataccaatttgcctctttcaaacctttccccttcctttaattatagtgctgcttaatctctgcgttgcttctagccctgtctgtccagcagtatatttgaaccaaagagaattccctggatgtggttttgacatccttagcctctggaacacactcgtaaaaattcaagatagttttatgagtgtgtttttatttttcctattaaattgtaaatttcctgtgggaatgagaagttattttttctgctgcctcattatgatatcttttaaacattttttaaaaagcctttaaagcgaaatagggagatgagcatggaaaataaaacttttggcagattttgaccaacaggctaattaaatatgtcatattcctgccaacagtagctgattttattaaacaaaactgtttctgtcatattgacaccaactagatcttgtagcacctccaaggcagtattttcaggtaatattctaagctatgactacctgacttatttgataaatttgtcaaccagtttagccacaaaactgttacatcatgattttgtttttgcctgttgaattgatagaatccagtagttgatattacatagacatggggatctgaaatgattagagtaggaaaaccttcagtgattagaattgtaaaagaggagattcatgtcgcaagtcagtgtcagccccaatcaaaaacaagagaactgtcatagggtacattgattcttcat

SEQ ID NO: 1223 - DNA, 195703 bp, mus musculus
gcgggcggtggtgccgcgtcggggaagagcgcatcccgcggggtgccgagcccggcgctggcggagagacgggggcgccccctccccacaggaggagcctcgcgctcctccgccatccttcccccgcgcggcgggctcgccttctcagtgggtgctgcgcgagctgccggcccggggtgccggggccagataagggcgatccgcggggccgccgcccccgggtcaggcaggccgggggcgggccgcgagtgaggcggggcggcggctaggctgcgggcggctggggggcgggggagcgcggagagccgaggggggcaggcggcgagcgggtggcccggccgcccgcctcgctgctccgcttggcgccgccggcccacgccgcagtgtgttttgtggacggcgccttcccagacagcccggtagagcccagctcagcgcccggcagccttcgacgcgatgttccgccggagcttgaatcgttttgtaagtacactcgctgcggctccgcgcgtgccggtttgcttgctcgccagccccttcgccgggtccctcacaacaattttctgagggggcagttacgtctctgggagacaccaccacccctcttcttccttttcaccgaaacacggtgcccaggcggccggggaggggaggcaggtagggctctcggggtatcccaccctcgcccccaggacaattcgaccagggcttcccggagctgttacaaactctgcctgaaactgggggccgccttcgggctgggtggtgggggggactcgtggggggaccgacccggggacccctcagtttgccaattagtcgaagatggcgttttattctcagggaggttgctttcttttgtttcctctgccacgagcacatggaggtaaacctagacctgtcacggtggcccaaaagaagagctgggggctgagggagccggagactagggcaagactcagccttgcctagggctcagccagcgggcggcttctgaccggaggccgggcaaactttggagacccagcctacaaagctcacctttagggtgtttgaaaggcgagcgtgattgtcagggtgggccgggtggatgtgcagccgcgaggaggctgcgccgccactgcccgtgctgccgatctctggtctgaagcctcgcggaggactgagcactccagaccttgaacccatgggagaaggcggactgtgactggactcctccgtccacgtttacccccttcagaatccccagaaaagggaatttcattttcatgggagttagccatagggaaaatcgctttctggctactgacttttttgagtaacctgtttactcctagagggtacattaagaatggagcgaaacaggaccatttacgttccgtgctgctatttgtagcaacttccttaattgcaagaggtggtggcgggaataggattttatttctgccaatgatgtggaagaaagggttcatctgcaaattttgatttttctgtagttaggaaaaagggttgaaagctgagtgctttcctctacctgccttaaaatatatcttttgagaacatgtcgatttggttttattcatgcaattattcctaatcaaaacgttgctaacatttttcatacatcggatatatttgctctcatttttccttcatttgaaactttcacaagtgtacactggctaaaagtaatacttgcacatccctttttagaatagtgctgtgttaatggttttctaaatgttgaccccacccaggaacatgcagtatgaaattggaacagattattacctgtggcatagagcagtagaggttgtacatatcaatcatcttgaaatccgtaggtgatggcttgtactgatagctttgctgaagcaagtgactaaaattggtttctcacatttagcctgagaatgcaagcgggtattgttcttaatagctgtttcacatagattcttgtgatcttggagtgttgcgtgggggtgacaaaaagggaaaggtggcaatgaaagctaattgtatttaggaaaaggataatcttttcacgtggcactcttatggtggaaaacaactgggctctgaatcataataaaatcattaaacttaagttgttgaaatcctttttttttttttttaaggatttgaacatttgaaaccgaacaactcaagtattggtctaaaagcccattgcttcccttttgcgaaaagtgatctgcatcgtatcagagtctagtaattaagcagtgctggcccaggaagccagggcatgcagtagaatttgcagcagttgttgaggtgccagcctgcaggtttgaggctagtactttgcatccccgaccaagatctcagcagagaatcacttttgctaatactgaaatgagctttgaccttattgttgcagctggaatattcagctgttcacattttcctgcgcagccatgactgtggtaagtatcaggaatttgtaccagtgcggtaagctggaaggttcttaggagttgtgtctgagccctaggcccagggcaaggaattaatctgcataccgttggactgaatgtgaaaattactatcaaataatcattgctaaaaaacggcttcaaaatttgggggaggggggcaatttttccatctcttagatcagtaaaccatgcgctgttctcctcttttgcctgacaaattctttgaggggtacttccatttgaattactagaagactagaattaaagatttgagtggaactttgagactttcacagcagtatagatgtagtcaaggttgtgagttgtcttatgattgttttaatattttagaaatagagctatgaattcctttcaaaatgagttgtttttttagtgtacctgtacgtgtctgatattggttttgattgtgaaataaattacagtggtgttgattgtagttgttggttattgaaaactagactacatattagagaagtgcttcctttatattttaaacctgacgtggaagaatcccttaggattcttacaagcatcatcttctatagctcagttgtgtttgctgaatcatttttgaaatgccatttatttttcgagttttccaatttcaagctaaaagaaaatagtgattcattgtatttttttaaatacatggtcttgacttctttgccattaataactgtgttcctttctttctgatgaattatgactttccttttgacagttttgaggtggaaagaaattggtggatttggtgtatagcattttagggttgaggcatgtagagggtgtcctaaaggatttaagagttggatgtctctgagtgcaataaaagcaccacctgttctcaagtcaacatctccataaatacagtaaataagtaataataactctgtctgtacaatttattttcttcaaaggcatatttaatcagaagtctggactagttgagatttaagggtcatggacttttatgttatcctgtcttgttttattcttaatgcaattcctagtgactatagtaacgtgttctcttgggtttaaagatttattgaaagtctaaaaacaattcccccctctttttggcttatgaaattattttatactaaagattcaaaataagagatttcttgataaagtaggttgggggcttggtcaagaggatgctgtcagtttagcttgtcagtgatagttaacaggtatgcatttctagacctttgatacatgaaagcttaattgtgagtgtgaaatactggagtacatttaaatctctgattctagaagcccttaaactgctttggtttcataaagcatgtagcatataatcataatatcacacagaagatgcccaggactaggaagaaattagactgcataaggaagaatggaaatttaaaataagactaaaaaatacaaaataagaattaatgaaataggtagctaatttattgctttgagtccaaggcaaggctagtctaatgaagcaatatatggaggcaattaagaaaatagttcaggtaattgctttgttttttccccaggagcaagaaggtttttagtttcccctttaaactatcagagtaattaaacatttttttttttctgtttcactttactaataatcctggcctgacattgacgagcgggaaaatattgattttattttactgtgtttagaaatatatctgtatgtatgtattgcaatatttttacatttgcacaactattacaaatggtctgtgtatctcggctcccacatggctgttcatagaggtctaggtttagcagttgaacttgaccatacttaaaagcaactttttttttttaaatcatattgtgttataattgccttttaacttgtatggctccctagtctttctcaacatggagagaattggcactgatgccctaggacatgcattgttagtaataaattaacattttcctgcgcagctggagtgaaggaaccctaattgagaaaggctgtcctagacagggacagttcacagtgtgttcttagctcctagcacagtgcctggtccctagtaggtgttcagtaaaatattttttgaaagaacaacttttgtatgtatcccataaataataacctttacttacagatagtgattattgtaaacccgctcttatgcagaatgagcaaagaatgagttcttgttagttggggtataccgtatacattactagtattctaagaattagaataaatacatctaatgccgaaagctatactgaccatagtataatctttttttttttccttttttttgagatttattatgggaattggatcatgcagttacagaggctgagaagtcccaggatctgccatctgcatgagcccggccacaaaatatccccttcttttatttatttttatttttattgttattttttttgagacagagtcttactcttgtcatccaggctggagtgcaatggcacgatcttggctcactgcaacctccgcctcacgagttcaagcgattctcctgcctcagcccccctagtagctgggattacaggcgcctgccaccacgcctggctaattttttgtattttttagtagaaacggggtttcaccatgttggccaggctagtctcgagctcttgacctcaggcgatttccctacctcggcctcccaaagtgctggaattacaggcaagagccagcatgcctggcctctttcttagatgattaaggcattgtatggttttgcagagcaattatcattcagcaaatattcactgagcacctactatgtgctgggcactgcagtcaatcctggggtcgtagatgagcaagacagacaaggttcctgtcttcctgagctgtaattatcattacatacacaactatagatatagagggcatggtaactgcattgcattgaatacatttgtgacataccatgaaatttgatctttgtgaataagttactattacatacttgtcatttttctttctactaaaaatagattgtacaatatcagttattttctggttgtttggatgtcagttaaaaaggagtttcttgcatttgtctcctttcatctgacctacgcatggcaaactgctcttttgcaaatagatgctaggctgaccccacgcaaggtgggaaacttatttagaaatgaaccactgtaacttgaaataaatctttacacaagtgaaagcaggttttgtcttcttttttcctgatctaccttttagtgactaagcaacataaaactctgaatgtgtcctgaatactttctgtaagtgtttactgtttgttccttttgtttatgcttattgctaataattcagccatttagtgagtaatattgagtgcctatataccaggtagtttccagtgttcctaattaacttttagctgaattgagatttgggcaggtgaagctggccatttttatattgatgcaactgttcaaaagagcttgttttttcaaaaagctgccagtttaccacctgctgagcagtgggttctaggaggtaaaggatggccagtggcccctgaaagaaccataactaaccttgctgtgtctgcatgatgtgcaaagaactagcccactgagtgaaatcaaatactggtttgttgagtgatggaaaaaatcaaggctcattgcttgtctaacatggttattcagttctctcaaagagggtgaatgcatgggatataaaaaaaaaatactatttttttcttcaaggtggtggaatttcctgtacatctgtagtgctttatacagatgaaccttttacatctggaaccctcgagactgggggagtttttctggttaggtggagggaggttctgggcttccacaaatgaattaggtgctggctctcgagtttatttcctttcacttaacatttaccttcttggcctggtataagggtagattagcggtgatcgtaaaacaaaacatactggcacaactgcagcatatgttaacactgctgcagcttaatgatgaatgagtgctcagcactgcagatatgggcacaggatgccctatgcccacacattggcagacagcccctcaattattgcagtgtatggacggattactgggtcggctgacttcttgataatagaagatgtgatttataaatgataatggaccgtggatttccagatttagaaggttaacctgtatttgtgaagtagaaatcattgatttcttgtgccatatgtatttaatggaatatgggaggattggtgatgttgatgatattgctgttcaagcagatatcatcatttgttttttagacgtctctattatatgttgtcataaagtattaatgtggcaatgttttcctagtccctttctctttaccaaggtattcttggaaaaatcagaagtgttcttgaaaatgatcttgcagttagcacagcatcaggtaaacagtagatgttcaattaatacttgtttaattgttttgagctgaattggtaacacagtctgagtcagtaataacagatgaagaatgatcagtttaggaagcagccaccaagaagcttatgcatttcagactgggctacaaaattagccaggagtggtagcacaggcctgtaatcccagctacttgagaggctgaggcgggagaatcacttgaacctgggaggcagaggttgcactgagccgagatcgtgccattgcactccagcctgggcaacaagagcaaaactccatctcaaataataataatcctgtatgcttactataaatacagattcctgggccttgaacttactgaatccaagtcttgggtgacagactccaagaaactgtttttaacaagcattccaagtggttcttaggttcactaaaatttgagaacagcaatatataatatagtaaacacggaaatatttattttctgggcacactctctgttcacctttttgaacttcagtttcttcatcgatagaatgggaataataatacctatttcacaagactgttgaaaaaaacgtttggtagactattcaacactataccaattgtgacagaggtcctcaaaaccggcctaggtttgttgattcactggcagaactcagtacatagaaacgcttgcggatgtgatttattatagcaaaaggatacagagcaaagtcagtaacgggaaaaggctcattggggccaagtctggaggaaaccatgtgcaagcttccagtcctctttcactgaaatcacacaggtcatgcttaattcctctagcaaatgagttttgacaacttgtgtgaaatgtctactagggaagcttattagagattcagtacccagggtttttagtgggagctggtcacacaggcaccctccacctggtacacagcaaaattccagaccccaaggaggaaagcaggtattcagtgtaaaccctattgtttacacagcttaagcagagtgagccactcttatcagggtgatggaaaccctcccaaaatccaagtccccagacaccagccaaggaccaaccttgcaaacaggccttactaagaatagcagtgtcaggcctgctatgttaactctttccatcacgcaaatattgtgaaacactggtattttttcagtgaaaggaaatgacttgtccaagatcattaagctaatcagcagtacagctgagacagactcccagcaatcacatcttttctttgctgcccatagccatgcttctagattatgggtcattccttttcatactgtcattgaaagcacttactgtttgtcacttgaagcagaagagcagcctgccggtggtaaattgatgcacccagtgggggagccaggaagtattgatgtttctgccagtttagcgtcaacacttgctggtttcctctctggagcatcgccaagttcgtggattttcatttttcctgacttttggacttttgttactgctcccattcatttgctcatagtcctaatactcatttgcatcatcacttcatcccattctataccttttgggtaacacaatttccaaatggtgggaatactgcagtattttgtcaaagaagactatataggaaaaaaaaaattctgagcaatgaattttatggcaatatttacaaatattggtttatatcctggattgtcttttgagttttatagtcatggaaaaccctagggatatctctggttatttggagtttcagccatttttactgttataaaggaaaattaacaaatttgttatgattggagcaaggaataaggaaatcatactggatggtgcagtaatcccacatatcgacagggagtagaagccaggagggaattgccacaagtaagtaacagctgggtagagcagattatgtaagctacacctgttgtgtaagcagtggggacgttctttaagcttcacaattaatgtattttgcagtaataaggattaagggatctatagtatagtgtacaatttattctggcttcttttctgaaaacattcatgtgaatcacagctttcttggaacactcatcccctatttggtgctgtagaggtgtgtaaggtacagccctgctcaccagtagcctgcagtttggtagaagagagagaagaccagcacacaggaccatcctccacacaaggccagtaggtcaccagagccatccttttgaaggacatacacagtaagtgcagtaggcattcagaaggaggcactggctctctggcttcatttcttggggagagctttatggaggaagtagcctgtcaactgggcctctggggacccaaagggctgaaggttctgagattttagggatgggcagtctcattacaggaggaggcaattacctgagcaatggtgcagggtcattgttgtacttaaagcatgggaaccagtcaatttagagaacatacatgccaaccccaaatgagtttgagctgttataaaaaaaagtataacaggtggggctcagtggctcacgcctgtaatcccagcactttgggaggctgaggcaggtggatcatttgaggtcaggagttcaaaaccaggctggccaacatggtgaaaccccatctctactaaaaacaaaaattagccaggtgtgatggagagcacctgtaatcccagctactcgggaggctgaggctggagaactgcttgagccagggaggtggaggttgcagtgagcagagatggcaccactgcactccagcctgagtaatagagcgagactctgcctcaaaaaaacaaaacaaaacaaataaaaagtataacatagattcagtggcttatgcacaacagaaatttatttctcacaatcctggaacttggaagtccaagatcaggatgccagcatggttgggtactggtgagggggcttcacgtcgcagactggtgacttattgtatcttcacatggcagaaaaagagtgaaatgagctccctagggcactaatcccatttatgagggctccaccttcatggcctgatcacctgtcagatgcctcacctcctagtactgtcaccttggaagttaggatttccacataagaattttaggggaacacaaacatcctgtccatgacacagcagaaacaccaaaacctcgatcttcaatgccttacgtttgctgtagtaattttgattttaaaaaaggagatgctaaaaacaggtggctttaggtctccacaacaatagctataggaatcttcccatacatagatgctcttttctgaaacctatgactccagtaaatttatgtcatttaaaaaaaatgcatatatatatatatatatatatatatatatatatatatatatatatttagagaaggagagagagagagagacagtcttgctctgttgcccaggctggagtgcagtggcacaatctcggctcactgcaacctctgcctcctgggttcaagtgattctcctgcctcagcctcctgagtagctgagactacaggcgtgtgccaccacacctggctaatttttgtatttttaggagagacagggtttcaccatgttggccaggctggtcttgaactcctgacctcaagtgatccacctgactcagcctcccaaagtgctgggattactggcgtgagctgccatgcccggccttatttggtgcagagacagtaaggcagagaccaggatgaaatatatatttggggtaatatatcatgacactacttcatatattattataggactgcttacttagttaccctgcttaaattatgggtacacatttctggtaactttcactacacatgggagacaggatggcagttcattttcttgagtactagtggtcatttatttaaaaagctggagatcaggccttttttcaggagcacattccttaccaacacatttatagttcactgctattagataagaaagcttttgatagactttcagatctgactgcatcattcggacttaccagaacatgaattgcatctcattccctctgtattagtctattttcatactgctttaaagaactgcctgagattgggtaatttataaaggaaagaggtttaatggactcacagttccacatggctggggaggcctcaggaaacttccaatcatggcagaaggcaattaggacgcaagacaccctcacaaggtggcaggaaggagaagtgccgagtgaaggggggaagaggcccttatgaaaccgtcagatctcgtgagactcactcactatcacgagaacatggggaaaaccacccccatgattcagttgcctccacctggtctctcccttgacaggtgggtattatggggattataattcaagatgagatttgggtggggacacatatcaccctcataaccagttcatcacgacaccatgcttagtcagtgccacttttctttatcatcatgactgccaccctcgtctaagtcattagcatctctccactttcatatttgttcctcctccagttttcccgttcagtaaatggcaccatccccctcctagtagctcaagctaaaaacctagcagtcatacttaatactaacctttcccttcatcacatttgtcagagaatccagtaggttctatttctgaaaatgctgtcacatccatccacctttcttcatgcccacacctaccaccattcaagtttaagctactgctgtcatttacctggacctttgcaattgattattttattatccacctttgccctctcctatctgtcttccacacagctccagggggatcttttacagacgcacaccaggagcacttcattgactttcgactgatttctggttaaatactttgctggtattgctctctctctttcactttttttcattcacttttaaaaactgagataattcacctaacataaaattcaccactttaaagtatacacttaagtggatttaaatttcctatgctgtgtaactatcacagctatctaattccagcacatttccactacctcaaaaagaaaccccatccgttagctcttagtcccagtcctctatccttcagcccttggcaaccacccatctactttcttatctctggattgccagtggaatcatacaatatgtgttcctttgtgactgaattctttggtgtagcatagtaatattttcaagatttgttcatgttgtagcatgtatcagtatcagtacttaattcttttttttttttttttgaggtggagtctgtcacccaggctggagtgcagtggtatgatctcggctcactgcaacctgtgcctcctgggttcaagcgattctcatgcctcagcctccaaagtagcttggactacaggcacgcaccaccacactcgactaatttttgtatttttagtagagacggggttttgctatgttggctaggctggtcttgaactgacctcaggtcatccgcccggctcggcctcccaaagtgctgggattataggcgtgagccaccgcgcccggactcattccttttgaaggcagagaatactccgttttatggagagagcacattttatttatctgttcatcagctgatggacatttgggttgttcgcactttttgactcttgtgaaaaatgtttcttcgaacatttttgtcctttcttttttatttttttattgagacagagtctcactctgttgcccaggctggagtgcagtggcgccatcatggcacattgcagcctccgcctcccaggttcaagcaattctcctgcctcagcctcctgagtagctgggacaacaggcgtgcaccaccacacccggctatttttgtatttttagtagatatggggtttcaccatattggccaggcttgtctcgaactcttggccttaggtcatccgcccaccttggcctcccaaagtgccggaattacaggtgtgagccactgtgcctggcacatttttttgctttttaaaatgaatatgtttttacttgagtatatattagtggaattgctgggtcatatggtaattgtatgtttaaacttttcaggaactaccaaactgctttcttcagttcttcctcacttaaataagtagtttgtgtgtgtgtgtgtgtgtgtgtgtgtgtgtgtgtgtgtgtgtgtgtgtttaagtttgagtgcagtgctgcgatctctgctcactgcaacctccgcctcccgggttcaagccattctcttctcagcctcctgagtagctgggattacaggtgcccgccaccacgcagctaatttttgtatttttagtagagatagggttttcctgggattataggtgagagccactacgccagccatgtgtgtgtttttttgagacagagtcttgctctgtcgccccggctggagtgcagtggtgtgatctcggctcactgccatgtctgcctcccgggttcaagctattctcgtgcctcagcctcctgagcagctggaattacaggcacacgccaccatgcctggctaatttaaaaatatttttattagagacagggtttcgccatgttggccaggctggtcttgaactcccaacctcaggtgatgcaccctcctcagcctcccaaagtgctggaattacaggtgtgagccacagcacccggccaataactagtatttttaattgtaaagaaaacacctaaaacttaccatctttctttaaagcatagagtagtgcaaattgtattcacattgtatgcaacagatctctagaactttttcatcttgcaaaactgaaactccatacccattaaacaacagctcccccacttcatgcagtattggtctttttgtgactggcttatttcacttagcataaagtcctccaggattctccatgttgtagcatgtgagaggattttcttccctttttttttttttttttttttgaaatggggtttcagtctgtcacccaggctggagtgaagtggagtggtttcgctttgtcacccaggctggagtgaagtggagtggtcttggctcactgcaacctctgtccccacccccacccccgccccgggttcaagcaattctcctgcctcagcctcccgagtagctgggattatatgggattatagttacccaccactatgcccagctaatttttgtatttttagtagagacggggtttcgccatgttggccaggctggtctggaacttctgacttcaggtgatccacccgcctcggcctcccaaagtgctgggattacaggcgtgagccacatgcctggcctgattttcttccttttaaagactggattatgtttcattgcgtatatatatattttgtttatacattcatctgtagatagtcatttggattgcttccacctcttggctattgtgaataatgctgctatgaacatcagtgtgcaaatatctctcttcgagattgtgctttcaattctttggatatatacccagaaatgagactgctgtgcatgtggtaattctgtgtttaattttttgaggaacttctgtactgttttcaacagtggctacatcattttacattcccattaagggttctagtttctccatatactcaccaacaattgctatattttttatagtaactgtctttttttttttttttttttttttttttgagacaaagcctggctctgctgcccaggctgaagtgcagtattgcgatctctgctcactgcaatctctgcttcccaggttcaagtgattctcctgcctcagcctcccgaatagctggaattacaggcgtgtaccaccatgcccagctaatttttgtctttttggtagagactgggtttcaccatgttggccaggctggtctcgaactcctgaccttatgtgatccccctgccttggcctcccacgtgctgggattacaagtgggaaccaccacgcctgacctataatagctgtcttaatgggtgtgaggttacatcttattgtgattttgatttgcatttcttggatgattagtgatgtgagcatcatttcctatgttttttggccatttgtatgtcatcttttgagaaatgtctacctaagtcctttacccattttggttgcgggggggttatttccttttttgttgttgctcagttgtaggagttatttacatattctggataatatttccttatgaaatatatgatttgcaaatattttcccacattccataggttgccttttcattgtgatgattacttactttgatgaacagaagtattaaagtttgatgtagtctcatcatttgtctgtttatgctttcgttgcctgtgcttttaatgtcatatccatgaaatcactgtcaaatccaaatgtcatgagtcttttcccctctgttttcttctaggagttgcatatttttaagtttaattgatagtttataagtcttacatgtagatcttcaatcgactttgagttaatttttgtatgtagtataagataagggtccaacttcattcttttgcatgttgatgtccagttttcctggcaccatttatttgaagactctcccagcatcgtaggacagggtaagaaaaaaagagaagactcttttcccccactgagtggttttggcacccttgttaaagatcatttgaccatgtacatgagagtttacttctgagatatttatttttattctgtttgcctgtgtgtctgtctttacgccagtgtcacgtggttttgattactttgattacatattgttttgtaatatgttttgaaatcaggagttgcaagacccccaactttgctctttttcaagattgttttggctatttggggtgccttaagattccatatggattttatggtggatatatattttttttaatttctgcaaaaaaccttcctcattttttgtgttccatctgccacaggaccgttgtatatactgtatattcctggtacacttctctcctgtagtcagttgtctcaactcttacttatttctgagagctcagcttaatcatcacttccctaaggaagctgttcctgatccttccctcagacaatgccaggttctcatgttactatgaacctgtccttcatactctttttgtagttgactttacatttgcatactgtatttggtaacttacttagtgtctagatttcctctatatagtatgctccatgaaggtaagacctgtgactatttttgctcattgctatatccctaatgcctcactgcctgacataatatgtgctcattaaatgcttgctgaataagtgaaatacgatttctatttgcatttctaatcttcccatttataattatagacttgtagtgcttgactgagagatcaaagactaagtgatgtccagtcttttttttttttttttaagacagagtcttgctctgttacccaggctggaatgcagtggtgtgatctcggctcactgcaacctctgcctcctgggttcaagcgatgctcttgcctcagcctcccgagtagctgggattacaggtgtgtgccaccacgcacagctaatttttgtatttttagtagagacagggtttcaccatgttgggcaggctggtctcgaactcctgacctcaggtaatctgtctgcctcggcctcccaaaatgctgagattacagacgtgagccaccgtgctggccacatgttgtgttttataatacatacatcatgcctttttaaattatgattttagttatttaatattctgtgatgtagttaatgaattaactctataagcttcactgtggtttcatacacatttacaacattgattttcttcagcaatttgctattatattttcaaagtacttaacgtactcctaaaatatgtacaactattatatatcaattaaaaaatactccagtataaataccaaatgaagtgtttattaatcaaatatttttttttctttttctttttctttttttgagatagagtcttgctctgtcacccaggctggagtggagtggctcactgtaacctctgcctcctgggttcaaattattttcgtgcctcagcctcccgagtagctaggattacagacgtgcaccaccatgcctggctaaattttgcatttttagtagagtcagggtttcactgtgttgaccaggctggtctgaaactcctggcctcatttgatcctcctgcctcggcctcccaaagtgctgagattataggtgtgagccactacgccaggtgtaatttttaagtccttttgataactttttgtctatgtgtttttcaaattcttgtttcaaaatttgtttttaaacagctttatcgaggtgcaagtacttttaatgttattatttttgtgagtttattgcaactttagggggtaccagatattcagcaatgatagtagtgtctcatttaagtccttattgcacaaagatggagctaatctaattattttatatgggtcaagatttgaaatttttaaaaatcttttttaaaattttactttaggtgtaggcatttgtgttttgtaggatatcttgaattgctgatccatgatttcattgatatgttgcaggtttatggaattgttatagttgtaagctgtttttctttgccttttaatcatcataacagcaaaacctagagtggtaagttccaggaactgttttaagtgctgtataagcattagtttattatacacatttggttattaggattctccagagaaacagaaccaataggatatatacaagaagtgatttatcataaggaattggctcatgggtttatgtagcttgacaagacccaagatctgcagtctgcaagttggagacccagaagaactgatggtgtaagttccagtctgaagactggtaggttcaagactcaggaagagtcactattcaattctgaaggcaggaaaatgcaggaggagttattccttagctgagggaaggggaagggcagcctttttgttctactcaggccttacactgatttgatgaggcccacccacattatggagggcaatctgctttactcagtcttctgattcaaatgttaatctcatccagaaacaccttggcggacacatctagaataatgcttggccaaatacctgagcatgctgtggcctagtcaagttgacacataaaattaactgtcacatttatgtcctaggatcatgtgaagatgaatgaacaaatctaaagtgtctataggccaggaatggcagactctactataaataattgtagtttgctagacttcccatctgtaaaataaagggcttgggctgctagatggtctgtaaggctcagtgaatcctagaactattaaagaaccttagaggccatttagtagtccaacatcttcattatagctgggaaaatggactgagagagggtaagtggcttttccaagattattcagtgaattgagaattcagaaatatggaattccaggctcagttctattgcccttgtcttcagtttccttatctgtgaactgcatgggctcctgggatgatatatatctaagttatttcccagctttataattctgtactatgtgtttaggcttagagtctacgagtgagcgaatcttttgactattttctgttgggtttttatctgttttactctttgggtctccatctcttgattgcacatttgacggtattctaccccaaatttcagtttcccctttaatagtaatgagtttgaactgaattttatatactttggatgggaacattgacaaattttaggaagtactgtttcactcgcgtccgtgtgaagagatcaccaaacagacttcgtgtgagcaacaaggctgttcatttcacctgggtgcaggcgggctgagtccaaaaagagagtcaacgaagggagataggggtgggactgttttataggatttgggtaggtaaaggaaaattacagtcaaagggggttgttctctggccggtaggggcgggggacacaaggtgctcagtgggggagcttttgagccaggatgagccaggagaaggaatttcacaaggtaatgtcatcagttaaggcaggaacaggccatttaaatttcacttcttgtgtgattcttcagttacttcaggccatctggatgtatacctacaggtcacagggggatatgatggcttagcttgggctcagaggcctgacactgtttatgggtttttaataggggtatactgtttagttttacactgatctgaatgattgaggatctaatgtagacccatgccttggttggtaactatgctctagaattaattaaactcaaatctaattatattaatcttttagctaacagcactaatggaggagaggatttttgttgatgctggaatattacgggcaagcttcctgggaatcaacactgcctttgccagtggtcacctgccattatttttcaaaagcactcttactcatctctacttatgaatacaattaattagttgcagaatgttagatagagtggcagtccttggacaggctgagtgacagctgctagaagacagtaggaggcaataagtagacaattcatgtgtatatacttgagaacaagtggtaatttggtcgagctgaattgggtgccatgtttattacagccagtgattcaacctaaggctgagagccctagcaagggagcagtttcagaaaattgagtctgtaaataaagtctattttaaaagtcataatcatttgttaggttagaccccagaccttgattaaaagtatcaggagaacatatatccctgttttgaaatttcaggcagtgcaattaaaatattcctgtaaaaattcagacatattacttattaaagatactaatgaaggcagtgcaatcaaaaatcatacgtaatcaaatcagaagatttattaatggatttatagaatccatgtttgaaattgatgattttaagtagtcatgaaattcaatgtgcattaacaagtatctgtttatttcctaatatgtacctcacattgtggaagttttttgaggtatgggggtgggaacttctttgttatggtgcctctactaatgagcagtgtagccttggaaaaatcacttccttttaaaagaaactgtcatttaaaaatgtaatattctatgcaaatagaatagatataaaatatgtgcataataataaaataaacccctgcatacccactacccaacttgagaattataacattagcaatacaattctacctatgtactacttccctatctcctctccttgccttcccaccaccgtgtaaccattagccttatttttgtaataatcattctattttatagttctaacatgtatgtatgcaaacttagatatttagctttcttattttgagctttataaaaatggtttgtatattgttttttactcaatattgtattgctaagtttttttttttttttttttttgagacagagtcttactctgtctctcaggctggagtgcagtggggtgatcttggcttactgcaccctctgactcctgggttcaagcgattcgcctgcctcagcctcccaactagctgagactacgggcatatgccaccatgcttggctgatttttgtattttagtagagacggggtcttgccatggccaggctggtcttgaactcctggcctcaagtgatccgccctccctcggcctcccaaagtgctgagattattacaggcgtgatccaccgtgcctggcctgctaagattctttttaaggttttatgtaggcataattcattcattgtcactgctgaataatatttcaccttgggagtttactagagtttatccattctcctgtcgatgggcctttgggttgttcacaggattttttattttcctggcatgatcagtgctgctaagaacaatatgtatcttttggtgtgtgtgtatttattaaaggatatttctcttgtggggtgtgtgtgtgtgtaggatttgcatatacatagaaacacaaaactgtatgtataggaagtctcacatacgtaatcataggtcttggaatgtgcatctttacaaaaggaggtaaaattgttacccagagtagttgtaccaatgggcattctcactagcaatatatgagtttccattgatttatattttctcaacacttgctattgtttgagttctttctttttgccaatctattgtgtgtgaaattttatttcacgatgatattaatttgcatttctctgattactaatgaagttaaacatttttgcatatgtttatgggccatttatgtttctctccttatctacttgtttatttccttttactattttctattgggttatctttctcatactaactttaagagtccttttcatattcaaaacactaaagctttgtggttatctatgttgcagatatcttctctaagatactttgccttctgcttttactattttttttttggtaccttttgataaacaagttcttaattttaatgtagttaaatttttctgtctttttctttatggttagtgctttatgtatcttgtttaagcaatctttctctatgccaatgttgggaagctagtctcctgtttcttttttctaaaacttttaacattttgcaaattattttttgagcctcacttttcaggtctttagaatgcaggtatggaactagatgttccttaacatatgttctggtctcttactctttgacactgtgacctgaagtagatttcggatatgtgactgtgttttcagaatatgcagtgttcttttttattttttaaagagggttttttttttatcatgtatctgtaacgttaggcaaaattatttaaagtcaataaatttttattcaaggaattccatgttgtgatttcttccactgtccatcaaggtcactttagatctcctaaagagctggagtcaaaagatttatcttcaagttagccgtttttaatgaaactgatgcttattttaatccagttgtcctgtcagcccataattctttttttttttttgagacagagtctcactctgtcacccaggctggagtgcaatggcagaatctcggctcactgcaacctctgccccctgggttcaagcgattctccagcctcagcctcttgagtagctgggattgtaggcacctgccaccatgcccggctaattttttgtatgtttagtagagattggatttcaccatgttagccaggatggtcttgatctcctgacctcgtgatctgcccgcctcggcctcccaaagtgctgggattacaggcagcccataattcttttattttggcttctgtcatctccttttaatatggatatactgatgaagacttcaaaattcaccaagaatctttgggatctaatttcttcaatttagggtcatttttactgtaggtggtggatctgcctggttctcaatttgacaccctctcttaacatgagttcaaatcatattcattcctaagtgatcacactcaagaatagtacagatgtgtggaatatgccaatacctgaggtaaaaaagtagattatcaggtctttcatacgtttagtaactgtctttttcaaacttttagcaactgtcttatagttctttcccatagatctagcaatagtcctgtgagtaaagtaaaaccacagttactttatgaggtgtttctaaggacgtgcaggctacaggaatgcagtgttcttttagtaacctttcccactatgaagtttcatatttactcctacttctctttctctcatttccccagcgtcttccttcctgttttcttcagaaaagtaaccagctgaattctgtagtatcctagagtttctgtgttgaaacagcatttttgatgtaaaattttattgagatatttatggatacacatggaattgtaagaaaaaatgcagagagatcccacgtactctacccaatttctccccagtggtaacatcttgtaaaattgcactataatgccacaaccaagatactgatgttgatgccgtccaccaatgtttttcagattttccatattttgtattcacttgtgtgtgtgtgcatggggtgtgtgtgtgtgtgtgtatgtgtttagttctatgcagttttatcccatgcataagtttgtgtatccaccatcacatcacagaccagatacagaaggaaagaaatgttatttaaaaacagtgtgggccgggcgcaataactcactcatgtaatcccagcaatttgggaagccgaggcgggtggatcacctgaggtcaggagtttgagaccagcctggccaacatgatgaagcccgtctttactaaaaatacaaaaaaattagccaggcgtggtggcaggtgcctgtaatcccagccactcgggaggctgaggtaggagaattgcttgaacctgggaggtggaggttgcagtgagccaagatcgcgccactgcactccagcctgggcaataagagtgaaactctgtctcaaaacaaaacaaaacaaaataaaaaaaaccccaaaagcagtgtggtttaaagtctctgtcactgagtacccccagattgttccatgtgcccagtttggctggtgcccatacagttttagagagcaatctcaggttacataatttagaagcaaattgattaactgaaactttgacctgagaaagcagaggagctttagtcctgggtcctgggaggccagttggcatggtcctaaagtataataatcatttattttaaattatatccccatgtgagcctgcattggaaacatcctagtaaaagctacttagtccatcataccaataggagtcattaaaattctacctgcttattagcaactaaaagctagtagtggaaagagggagtgataatccttctaagaaagcaataaaaaatctgccaggttgtgcattggtttatagccccataaatagaaacttatgttattgtcaggaaggtagtcaaggacatttgaatactgtatttatggagagctacatatgctttaagtaactcatatccaccccaacatacttaaacatgcaacatctttagtgaagttcatttgtttactcctttattacctatttataaccagctaggcactatatgctaggcaatggggaccaagtggtaaataaaaacaaaagtggttcatgtcctgatggaccttataatccagtttagaatggaaaacccaacacattttttatttactcattttcataagtgttatgaataaaatgaataggatacagagatagcagaaataggatatgttttgatagggtaacatgaaagttctgtcagaggagatgacatttaagcagataactgaaggaatgaggactacttctgcaaaggggtttgggagtagttactggaaccagcttgcacaaagaccctgagttgggcaagagtcaggcacattggagaagcttaaaggaggctagtggggctgaagggcacactcagtggaaccgggggaagatggcagtgaatgggatataggaacttctggggagcatttggattttgtaatctaatttctggtagccatgaaggtgatctggagatggggagggcgatgataataaagttgtctatttaatccattcacacatatttattgagtatcctatcacatgccagacactgttctacttggtagggatggactgatgagcaaaacagacaggaatctctgacctttttgtctctacattctaatgtaggaagctgttgttagggtacagggtaaaataatgtaacaaagagctccaaaatacagtggccaaaaaattatagacgtttggttctctggcgtgtaacaacccagagaaggtaagcagtctcttttctttttcttttcttttttttttgagacagagtgtcgctctgtctcccaggccggagtgcagtggcgcaatctcggctcactgtaacctccgcctcctgggttcaagcgattctcctgccttagcctctcaagtagctgggactacaggcacccaccaccatgcccggctaattttttgtatttttagtagaaacggggtttcaccgtgttagccaggatggtctcgatctcctgacctcgtgatgtgccccgctcagcctcccaaagtgctgggattacaggtgtgagccaccgtgcccggccagcagcttcttttctatgaggccatccaccattccaggctgtgttggtcaattctgtctttcacagcatttgatttttaaagttccagccagcatgaaggaaagggagtccaggagaagcttctttaggaaggtgacagaaactttcacatattacttttgcgcacatgccattggagaaatcttagtcatgtggccctccctagccacaagggagacagggaaatgtagtttctggttggaaagtgaggtgttcaggaagaaaggaagaacagatttgggaggacaatccagtggacagggagacaggcagtaaacaacataattgtaatatctcctgtgatgagtgataaaggaaagataaagcagagaatgatgatagaaagtgtcaggggtgagggttgcagtttttcaaagggtgaagaaggcctcactgagaaggtgtcatttgaataaatccccaaatgaagttttgtgagcaagaaataccattttgggttgttatgaagcctataagaatgcatggttggttttaacatgcttgagtctaggaccttatcagaccccatcagaaagtagttagcgtggaaagacaccattgtgccacatattcacctactgcaagcaatacaaggccttaatgaatttttgttgttgttgttgttgtttgttttgtttttttttttgagacagagtctcactctgttgcccaggctggagtgcagtggtatgatctcggctcactgcaacctctgctccccgggttcaagtgattctcctgcctcagcctcctgagtagctgggattacaggtgcctgctacggcaccgggctaatttttgtatttttagtagagacggggttttaccatcttggccaggctggtcttgaactcctgacctcgtgatctacccgccttggcttcccaaagtgctgggattacggctgtgagccaccatgcccggccaatgaatgttaaattaatgagttatgctaggacctggactgaggtatctgattttttcttgactttttttttttcgttttttttggagacagtgtcttgccctgtcaccaaggctggagtacaatggtgcaaccacagcccactgcaacctcaacctcccgggctcaagcgattctcccacctcagcctcccaagtagctaggactacaggtatatgccatgaccccagctaatttttttttttttgtagagatggggtctcactctacaggttggtcttgaactcctgggctcaagctacatatgctttaagtaactcatgtccacctgcctcagcctcccaaagtgctgagattataggcatgagccactatgcccagccttggctttttcttagatggaaagcttagctcccaaagaagggagggactaagattcttctgccacacacagttaagagtgttgcacatacttggactgtagaggtgtttgttgtgggggcggtgggaggggagatagatttttgctaagggtagaaattatttatggtctgagtttgctgtagagctctagttaacttcaattagccattgtcagtgcggtttaaggatgtggtgacatgaaagagtggaagtattttcatttttgcccttgatcttccattcatttttgcccttgatcttccaaatcttgcttagtagcctttccaattacagcaggcaatattttccaaccttttactattttctttaattatatttgattgctgctttaaacatttttacataaaatacgtaagtactttaaaaaaaaaacttttcctgtgtcacttttttaaggataactcatttgtttaatgagccaaaagaaaataattttctgcctattttttctctaatccccttcctacttacaacatccctaggttggagtacatagattgtctttgggatttcttatttttgtggtaaattatgtttcactagggaacttacagttttagaagggagataagaaacattgttatataatgaaaatacaagacagaaagtgacaaatgctatgagaaggtaaaagtaagatgctcctatagttcagagactatggcatgagatgaataatcctgtcagtctgcttccacaaatgtgaaaggagacattaaagctacctacgagcttaatatataatgctctcaaaaggaattttccattcttggaaaagggaaacatttgatctgtcatcctactgtttatttttgtaagccccgtcttttcccaggcacagataaaatccattgttttcctctcacactatgccatagggaaaaattcaattcagattggaaaaagcactgctaatcacttcacaacattttgtagagttagccttgaatctttcttcctttccctcactccgtcttacccagtccatcacccaattccacagattgtggtcccctgaattgtttttttggatccactcttgctactcttattccatctctgcaaagcagctaggctgactctttttgaaacatacattaagttagtttctagctaagaatccctagtagctccgttcatacttagagcacgattcagactccttactctacctgctaggctctgcatgcctgcctgcaacagtatctctggccttctctgagggatctaccctcctactgtattctgtttctactgtgtgcggtcttcccactatatggaatgctctctccccgaggaccccatttctgctcctccttcagaactaagttcaagtgtcttttccttaaagaagccttccctgacccaggctaatgtcagaccacccaatcttacagggcctcatagtaccttgtacttctcttatgtacctcttcctgcaattgtaattaatgaattacgagactagttattagcccccctctacctgtagaacaacatctaaaaaataaaaaagcatattattttttcgagatggagtttcgctcttgtcgcccagtctggagtgcagtggtgtgatctcggctcactgcaacctctgcttgctgggttcaagctattctcctgcctcaacctcccgagtagctggattacaggtgcccaccaccacgccaagctaattttttgtatttttggtagagatggggtttcaccatgttggccaggctgatctcgaactcccgacctcaggtgatccacccacctcggcctcccaaagtgttgggattacaggcgtgagccaccgtgcccggccaaaagcatgcgtgttttagtttactcagtactccacccagtgccagtgtccagtctagttctgggcactggaataaatgctcaaaaaatatttgttgcaaaagaaaaagcagaaaattcacaaattatgtaaatttagttttgaattttgtttaggtccttacatttgatcgtaggttttctaattttgttagagtgtttacaaaagacaagacagtgtatcacatcacctgggagctgttagaaatgcaattctcaggcccctgattcagacgtactaccccagaaactctgggtagggcctggcaatctgtattctaacaaaccctccaggtgatggtgaggcataataaaatttgaaaaccggtgttctataaaaatattgagtgaaggttgtctttgccctagttcaggctgctataacagaataccacagactgggtagcttaaacaacccagaaatttacttttcaaagttctagagcctggtaagtccaagatgaaggctctggcagataggatgtctggtgagggcactcttcccggtttgcagacgctgtcttctggttgaaatcagagagagggatagcaaactctttggccttaaaaaaattttttttatagttaatttttttttttttaatgcttaccggtttattataaagggtactacagaggatacagttgaagagacacatagggtgagatatgggagaagaagctcagagcttccaggcccttcctggggttgccaccctccaggaacctccacgtgtcagctatctggaagcttactgaaccctgaccccttgggtttttatggaagcttcaagacatcagcattccttcccccagggtatagggtgggacccttgcatggaaggctcttaagacctacaataagaaaggagggcaggaaaaggtcagaggcctgccccctgagtcctaacacacccaacattataacaaaatgctgtaacaagggctatggaagttatgagccaggaaccgtggatgaaaaccagtatataccataataccacaggccaccccctggtttttgactatggatttttcacataaaagtatatactatgcacaatcattaataattacttcagcccatcatagtatatgaatgtcttccaagatgaggccactcctgtttgtgggtttcttctcaatcttgtcagcttccaaaagcaggagtggccttggtaaatatatatagctttaccctttcaggcatctgggattattgagcttatagacaatgttatctcttgctctgagactcttgagttggtaacataatatttaattttcctcaatatcccatttattcatttctttaatttcagctagtatttctccttctctccgttggtacactaactttttcaacattggaagagacattagaattgtcactgtgctggtctagatagcaggcagcagtacaagtctggcaagtacctcctcctcagtctactcagacagggtaaggttacaaaggtgtagaactagtgagctatttttaccaccaggcaatatagctgcaatcacagttagccccaattttgctagatggattgaaggcacaatccatcatgaccttaggaattttgacgtaaggtttaaaaacatagtttgttttttgcttagaaatcatccctgctgttctaacacttgtacttgcagccctggtcctagggccattgcatcaggtaggggagaaaaaattaatatttttttcctgaggtgatttgaggaagaaagaacaaactatagtcgttatgttagtgtagtcctcccttggcaggaactacatagtcatatcagtgtgaaccccagatatctgagataggtccagttaatttaggaagtttattttgccaaagttaaggatggtctgtgacagcctcaggaggtcctgatgatatgtgtgcaaggtggtcggggtacagcttggttttacacattttagggagacctgagacatcaatcaatatgtacctcggtttagttgggaaaggcgggacaacttgaagctgggaggggcctttcaggtcataggtagataagagacaaaagattgcattcttttgagtttctgattatcctttccaaaggaagtaatcagatacacattcatctcagtgagcagagggatgactttgaatagaatgggaggcaggtttgccctaagcagtccccagtttgacttttccctttagcttagtgattttggggttccaagatttaatttctttcatactggcatcttccccaccccctcttccccagataaaccagaaaaacagaggaaaaaaaaatctatcagggacactctagtcccattcatgttgaggtgtgagcacacactcatgaaggtgtgtaagccagcccttcatgcttttatctccccgttttagacaaccaaggtttcagttgcccattctacttctctgtcaaactgttacactaaggatatcttgctactcattgttggactttgtgggctgtacagtgtgttccttggtctgaaaaaatgatggccagccatccaaatctatacaatatcttctatatttttttatggtactctgagcattttcatcttccattagataagcaaagcccactccagagtcagtgtttattcctgtcaggtcccatttttagcctccccacggggctaccagcattagtctcagttgccagctatgttcagggccttcccaccagagaatctgccccgcagccatcagcaatctctgtctcttttgctgagaaacagaacagttctttctggcattttgtgcctgagagggtgcaaaaggaacatgtctagattcagcccatcactgtagtgctacaatacccccatatccactcatttcatgggcccaggtggccacttcaagggagcacacagggatatctacttgtcgattccagtcaacttccaaacctggaagggagttctgatgggcactgacttactctcctttaatgccccctcacgtctccacagggccatgcttcatttgggcattcttttgatagtccaggtgtccatggccctcttgtctgagtgtatggctaggccattggtcactgcccatgagtcagtaaaaacccaaacccaggggtttgcaccattgttcaattctttcatcactgttagaaaaactgcatgtaattcagcccactgagtggatctgtttttaccttctttgatctaagtagcagccttccaaacaggatggtgtccattcactttggaactgtctggcttcttttaagggcactaactcctccaggcttcactgccatgatctaatcacctctcaaaggccctaccttctaataccatattgaaggttaggatttcaatattaagaacttggggttggagggggaacccaaacattcataacacttggtaagtaaaatataaagtccagtttacacctccttacctatttacaaaattaagtgcattgtttcttaccaacactgggtaatgaacttctttttgccccctccccattttatcagttgatgtcttcagatgttacccggaatgtaaacaagctctgcttgaccaactgaactgtaaacaagtctactcaaacctgaactttaaaaaataagggttctccaacttctgcctcctgaattcctgacttttatatactgccatataagtccaggattctatagtaactgttggagggttttaatttttttcaaaaatgtttattgtaaaaggacaaaacttttttttccctctaaagcttagatggtagtttctgattttgtatctaaagctttgtgaagcattagcaattttttttttttttttttttttttgagacggagtctcgctctgttgccaggctggagtgcagtggcaagatcatggctcactgtaacctccacctcccgggatcaggtgattctcctgcctcagcctcccaagtagctgggactacaggcgcatgccaccacaccccgctaatttttgtattttttgtagagacggggtttcatcatgttggccaggatggtctcgatctctcgacttcgtgatccacctgccttggcctcccaaagtgctgggattacaggcatgagccaccgcgcccggccagcattagcaatttttgaatgtgcatatccttggctgttcaggctccaggattgtgctacacaatcaagttgttattgctgatggattgaccacattgttaaaataggtcgctcatccccgattttgccgctggctcttaattcacttcatgtttgactcaaagacactattttgacaaaactacttccatctgatgactattagatgagccataggaaattaattgcaggtttctttcttgtacaacaggtgtccagggctcattgattctctttctgatatgtggttagaagcagagtttggggattctttcttgagataaccaagaaatctttttaaatgtttaaaaaaaatttttattttagaatcattttaaatttacagaaaagttataaagatcgtgtagtttccatatatcctgcacccattttccctattgttaacatcttgcagtagtaatgggtaatttgtcacgattcatgaatcaacattgatacattattttaaactaaagtttatactttatttagattttctcggtttttctttaatgtcattttcctgttctggggtcccttccaaaatgccacattacatttttttttttttttgagacgcagtcttgctctgtcacccaggctggagtgcagtgatgcgatctcagctcactgcaacctctgcctctcaggtgcaagcaattctcctgcctcagcctcccgagtagctgggggttcccgccaccacgcctggctaatttttttgtatttttagtagagatggggtttcaccatgttggctaggctggttttgaactcctgatctcaagtgatccccctgcctcggcctcccaaagtgctgggattataagcttgagccattgcatccggccccacattacatttagtcatcatgtctcctcaggctcttcttggctatgacagtttctcagactttccttcattttggtgatgttgacaattttgagggatactggtcaggtattttgtagaatgtccctcaactgggatttgtctgatgttttcctcgtgattagactggtgttactgagttttggaagacgagagatgaagtgccatttcatatcatatcaaaggtaaatgttaacagcatgacttaccactgttggtgttgctataactcagctatctaaagtagtgattgccaggttcctccactgttaagttactgtttttcctctttccatactgtactctatggaaacaagtcactaagagtagcagaagagattgttatttaagtaggagattctaaagaatatcatttcttgctgagtgagaccttctccattgtttttcagtatttccttttaagttttactttattaggagacaggtgtatgcagttgacatgtttcaaatattgatttaaattgtgaagggatttgacattaaaatgaatattttagtgaatattctggagcacttagttggaacctaacgtatttgtgtaaatgctcctgtgtccacctgttgcccacatctactcatccccacgtctactcatcccccagcctccaagccttctctgtttgcctgtagctcctggaatctgattgcctcatagctaaaacctttatgaaaacatttgggtagagtagcccaggatttctttgcttggtaagaactcacttgctaaaatggtttttattaaaatatgtttgtgcttcactactgtgcttcttttgctagaatagatgcagccctaaagatttgcttgtcttcctaattcctttcttaatacctcatagtagtgactgagctattgatctgaagggataataacagccctacacgtgctttttgcaggttctgatatcttaagaactaaccgagagctttgaaaaagaacattgccttagtgacataaattcaagcctgcttcaaaccaaataatatacagcatgtgtcataaagaaggttcattcctagaaatcatcatattcaaaaggagcaaaggatgaggaagaaggaattacagcaagtgatagtacttgctcaaagactgttaaccagggtcagtgccatgggaacattgtctccagcagccccactcactctctacccaccccactcctaattcatatccctggctgctgctgctttttttttttttttgacacagggttttgctctgttgcccaggctggagtgcagtggcatgatcatagctcactgcagccttgacttccccgttcaagagatcctcccacctcagcctcctgagtagctgggactacagtcacgtgccaccacgcctggctaaatgtccctggcttctaacatgcacttaaagcacttctcagaaagactgtcccagtagaaaaggtgcacagaaagtaaacaattcactttttcttttttcttttttttttttttgagacagagtcttactctgttgcccaggctggaatgcagtggcgccatctcagctcactgcaacctcctcctcccaggttcaagtaattctcatgcctcagcttcctgagtagctgggattataggtgtgtgccaccatacccagctaatttttgtaatttgagtagagacagggttttgtcatgttttgaactcctggcctcaagctgtccgcccgcctcggcttcccaaagtgctgggattacaggtgtgagcctctgcgctcggcccaattcacttttcactgaagttgacctttagtatattgttagtagttttggattctagtttgagttatcactagaaaaaatagtgaacaatattttattattttttattgatacataatagatgtacatattttgggatacctgtatatgccccatacccagtttcccttattattttgagacagggtctcactctctctcaggctggagtgcagtggcccaatctcggcttactgctaccttggcctcccgtttcaagtagttctcccacctcagcctcccgagtagctgggaccacaggcatgcaccaccatgcccagctaatttttgtattttaggagagacgtgatgtcaccattttgcccaggctggtcttgaactcctgagctcaagccatctgcccacctcggccttccaaagtgctgggatttcaggcgtgagccaccacacctggttcagtttcccttattattaacatcttacattagaatggtacatttgccataattaataagccaatattaatatattattattattgggaggctgactgggccttgaggtcaggagttcgagaatagcctggccaacatggtgaaaccccgtctctactaaaattacaaaaaaattagccgggtgtggtggcatgcttgggactacccaggaggctgagacttgaaaatcgctgaacccaagaggctggggttgcagtgagccgagattgtgccactgcactccagcctgggcagagagagagagagagagagagagagagagagagactctttctcaagaaagggaaaaaaagtgtgtgtgtgtgtgtgtgtgtgtgtgtgtgtgtgtgtgtgtgtgtgtataaaattaactgaagttcatacttcattcagatttccttagtatttctcaaatgtccttttgctttttcaggatcccatctaggtcaccacatcatatttagtcatcatatttatttggactcttcttggctgtgacagtttctcagactttccttgtttttggtgactgacagtttagaggaatactggtcaggtgttttgtagaatgtccttcaattgggatttgtctgatgtttttctcatgattagatgtgagttgtggattttggggaggaagaccagggaggtgaagggccattctcatcatatatccacggtacatagtgtcaacaggcttatcattgatgatgttaacttggtcacctttctgaagtagtgtttcttaggtttacacactgtacagttatctttttaaaaatgatttgtattgatttttccgtctctgattctggagaggagtatggttcattttatttattcattcagcagaatgaaatatacagtagattattgttaactatagtcactctactgatctatccaacactaggtcttatttcttctaagtgtatgtttgtacccattaatcaacctataatcccagcactttgggaagctgaggcgggcggacagcttgaggccaggagttcaaacatggcaaaatcttgtctctactaaatgtttccagcaaaaaaaagagataagtgtttaaggtgacctttagtatattattagtagttttggattctagtttgatttatcactagaaaaaatacatctcactgtgtttagatgcgtctactataaaagccaaatagacaaaaattaactgggtatggtggtgcatgcctataataaggtgatggatatcccaattactctgatttgatcattacacatgaatgtatgaaaatatctcactatgtttagacacatctactataaaaggcaaatagacaaaaataagctattctaggccaggcgcaatggctcacacctgtaatcccagcactttgggaggctggggcaggtgcatcacttgaggtcaggagttcaagaccagcctggccaacatggcaaaaccctgtctctacaaaaaatacaaaattagctgggtgtggtggtgcgcacctgtaatcccagctactcaggaggctaagacaggagaatcgcttgaacccaaaaggtggagactacagtgactgagatcgtgccactgcactccagactgagtgacagagcaagactctgtctcaaaaaaataaaaaaaaaacttattctaaaagtagggattttttgctggacaaatttattaatctaagttctgcctaatgaggtctaggggaactccctgaatttgagcgaaatgccaaaaaagtaagctaaaggatatttaggtttacattattttcctcactgtcactttccagtatctcttatatccgtttaccacgtggaagaatctagtactcacttttaaaattttttgagatggagttttgccctttttgtccaggctggagtacaatggcatgatctcggctcactgcaacctctgcctcctgggttcaagtgattatcctgccttagcctcctgagtagctgggattacaggtgtgctccaccatacccagctaattttgtatttttagtagagacggggtcttgctatgttggccaggctggtctcgaagaatgtgattttatttatgatttaccagttattagactttctcacctcttcagtaattttagttttttattatttttattgatacattaatagatgtacatattttgggatacctgtaatattttgatacattcataaaatgtgtaatgatcaaatcagtaattgggatatccatcacgttaaacatttatctctttttttttgctggaaacatttggaatcttcttttctaggtattttgaaatatacagtagattattgttaactatagtcactctactgatgtatcaaacactaggtcttattcttctaagtgtatatttgtacccattaatcaacctctcttcatcttcccttcccccaaactcttcctctgataactaccagtctactctctatcttcatgagatccatttttgtagctctcacatatgaatgagaacatgtggtatttgtcttcttcacttatttcgtattcgtaagtagtgaaaagtgtgtccttaagtgagaccttttctgtcttcccagctttaatataaatacaaaagattgtgtgatactagggataaagcaacctccttattttcattccttcaaatgctagtcaaggtaacagatgaagatcagaaagtactaggaaaagaagtcaccatcacatcttgtgttgaaatttgttagggagtttcagtatcaaggaatgagtatgtcatgcagcagatgagcctctaggatgaatttgattaattcttcccagcagcaaaatctcataatcaaataatgttgcttgaggccttcttttgctttggagttagagaatctaaattgtgtaagctctagtggatttccattctgtcgtatcaagtatcgatggtctgtgtgaatggaaagagcagattttctgttgggctatatatatgagctcattggaaagagttaagaattattaaaaaaaaaaagaattataagtaaatacattttactggatttaacttcctaatgacaggcatctctaccagatttgatgatactgcaaacatggaaggaacataggcatctgggtttctttgctggctatgccactagtttgttgtgcaatttttttttttttttgtagtttgttatgtaactttctcaatggtcctcagattttcatctgtacagtgagagtaaaaaggccagagcattgcttaaaccccttaagaccatctaaatctgtggttcagaatgggaaataagagtagcaatactgactgtcttcccagttacctgttatgctcatgataaggtacattagataaaaatgtaagaggaatctgattttcccacaaaacgtttcatatatagttggggacatgatcttaacctggtgtcaaattcttttttctagatatgactacaaatatgagaatgaataaattatatgaaatgtgaacatgaatagatttctaggtaatacctatgggccatagagctttttaagatatgcatttttgaccaggcctggtggcttatgcctgtaatcccagcactttgggaggctgaggcaggcggattacttgaggtcaggagttcgagaccagcctggccaacatggtgaaaccccatctctagtaaaaaacaaacaaccaaacaaaaaaacccaaaaattagccaggcttggtggcacgcttctgtagtcccagctgctcgagaggctgaggcacgaaaatcgcttgagcctgggaggcagaggttgcagtgagccgagattgccccacttgcactccagcctgggcgacaaacattcctaaaagtagttgtgagtggagtaaatgtacagagacaagatctctgtatactggattccatattcctcttctcctttctttctgtgtgacaggctctcattctctttcactggtatttttgagcacctcttttgaacttagaggcgtgcctcatactctctgatgttggggggactgtgtgagcctgttggcttctctgtctacgtggctttccaatggacagagctggggcaggtcagccctgaatgaggctttgagtcttagcctgtcttgagttagagagaattttgggaacctcagactgctagctcagcagttcagcatgtttgctagtatcattctgactttgtgtggtcatgtttttgtaagattgctgttgtctggctcgttgtgattaagactagcccttgtatttctgggccagaaactggtccttactctgtttatcccctgtgaagtccttttatgggtacaatggttggcaccccaattcatccaaaggtaggaacatgttttctttttagctaagcttctggggaacttaagctctgcctagacccatacctgtggttgggtctttgctgcccaatcctgatgttatagatgctcacccactaattgcctttttaccagatttccctgatgttatattctgtctgcttttaccttgctgagtatcctcatgctcactgctcacctgcctggacctttggttgttgctgcactgtcttttctagtaatgtgctcttgtcacttggatttccttctaggccttgcttctgggtccacctccaagcacctgacattctgtactttttgatctgccatgctgcctgccttcagtagcttaattatgaaaatcagtagttttctttctctggaacctttattttaaaaatctattactaggccgggtgcagtagctcgcgcccgtaatcccagcactttgggaggccgacacaggcagatcacatgaggtcaggaattggagaccagcctggccaataaggtgaaatcccatctctactaaaaataggaaaattagccaagcgtggtggtgtgcacctgtaatctcagagacttgagaggctgaggcatgagaattgcttgaacctgggaggtggaggttgcagtgtgttgagactacaccactgcactccagcctgggcaacagagtgagaccctgtcttaaaaaaaattaattaggggcaagggagaactagaatcatgaaatctttgtattgaaaaagactctcagaagcttatacttcaactttccatcagatggatagcttggtaactcccaagataacccatcaatcgcattttgcagtacctctctattggtttcttgtgccaaaaccatcaatgcattcatttatttattcactcattccttagtgtctgcacagttactaaacatctacctttagctaggcaatggggagatgagtatgtgtgcatgcatgtgtgtgtgagtgagagagagcattccagtttctaggaagctgctagtccagttggggtagagaataaacaatcatgatggctagctagagatatacattgggcgggagaatgagtcattttctctgcatgactgaagggtggttcatggagggctttctgccattccagttaacaccaactttctctttttaatttaacttttattttaagttcggggtacatgtgtaggtttgttatatagttaaacttatgggggcttgctgtacagattattttgtcactcaggtattaaactagtacccattagttaacaccaactttctagtccaccaccagcttttcagctaaaatacaggaaactcctcatcttccttcttttttttttttttttttttttggccaatctctgacttgcttttggaatcatctttctttatgcaaatcttgatttgttcttcccctgttcataggctgcccattgtttaccccacaccccacaaggatatctaacttcttggcataactcatgaagccttcgacctttctgattcatgcctacttctccagttttattacatgctattttctatcaggttcttagtaccctagaacttaatgaagtttgctggctacactgtgcttacttgtacttctgttgcatgtgctgttcccactgcctggagtggttgccatttttgctttcctggtgaactctggggcactgagaacttgatagaaaatggtatatggggaaaaatcacaagtctgattttcctcttctgttatggcgtactccagcctgttggatgctgttgcactttatacaccccccactcctgcccaccacaagattgtaaactacttcagtccaggttatctttatgtcttcagtttaacacagagcctggcccagagtgggcagtccataaataattgttggatgaatagatgaaggaatgagtgaataaatacaagtttctatagtctgtttttcagtttacttcttccttggggctctgataatggtacttaaatggatcctatcactgttttgtttcatttagagatggggtctgacactgtcacccaggctgaagtacagtggcattttcatagctcactgaagctttgaacttttaggctcaagcgatccttccacctcagcctcccaagtagctggaaccacaggcatgttccaccatgcctggctttttaaaaaaattttttgtagagatgaggtcttgttttgttacctaggctggtctcaaactcctggcttcaaggaatcctcctgcctcggcctcccaaagtgttgggattacaggtgtgaaccaccacacaaaaccacactgttttgaccatagctccttgcaaagccagaaccatgcacactggcttatccactactggataagctacctgcctgccaaaacagagagaaaagccctttaggggttttagaaaactcttgatcttctcccaccctgttgtctctgctgccaagataagcttctactatgtcttttcagaactctgatcaagaggtagaaattgcatagaataaaaatacttcaccccttctcttctaaatcagagtggttgtgaagtgaggagaattagtacttgaataaaattcctgtctccttaggcagttctttgaatgagtcatctacaaactcaagcaatttgtaaggacaattatggccatttattctgttgtcagcctgttttgaataaataccaaatggagtattttggttcttaattatgcctttctcaccttcttaccagagcccgtttttacacaattatatcaattaacagtgagagacacatacacaactttcatgaacttaatctgccctgcatatcttcctgtgctttaatcatgatcttaaatttataatcagaaatcagccttttcagttcaaatcagttgtagatctctgcctaaaatagttggctctttcgaggttgttacttttgtaacacaacttttttcttgagaattattgaggtataatttacatacagtaaaatttgccctttttaggtatgtaaaaatcgatgaattttgacaaaattatataaattgtaatcaccactgaaatcaaaataatcaaattttctgtcacctaaaaagttccctcatgctcctttgtagtcagtcccctccctaaactgccaacccctggcaaccgctaatctgatttctgtcccttacagtttcgtcatttctagaattccatataaatgggatcaaaatgtatagcctttgagtctggcttgttttacttggcataatgcttttgggagtcatctatgtccttgcatttatccagtttgctgcctttcattgctgagtagaattccattaaagagataacactataatttgtgtatccattcaccagtagctgatggacatttggactgttttcactttttggtggttatgaataaaggtgctgtaaatatttgtgttcaggccaggcatggtggctcacacctgtaatcctagcactttgggaggccaaggtgagcgagttacttgaggtcaggaattcgagaccagcctggccaaaatggtgaaaccccatctctactaaaaatataaaaattatctgtgtgtggcggtgtgtgcctatagtcccagctactcggaggcggaggcatgagaattgcttgaacccgagaggcggaggttgcagtgtgctgagattgtgccactgcactccagcctgggcaacagagtaagaccctgtctccaaaaaaaaaaaaactgtgttcaggtttctgtgtagatgtatatcctgttttcagtaaatatataaaagcatcatagactgaaatgtactgggtacattttcatactgggtagtatgaaaactatgtatttaactttatatcttaagctgcccaactatttttcaaagtgactataccatttttgtttcctaacagcaacatataaggttgcatttgctccatatcctcaccaatattgttattgtctgtcctttaaaactttagccattctggtaggtgaatagtaatatctcactgtaattttattctgcatttttcctaatgactaatgattttgaacaagtgtcttaacatttttttgatttggcagggttttgaaaaattatacagctttgggctgggcgcagtggctcacacctgtaatctcagcactttggggccaaggtgggcagattacttgaggtcaggagttcgagagcagcctggccaacatggtgaaaccccgtctctacaaaaatacaaaaattagctgggcgttgtggcgggcgcctgtaatcccagctactcgggaggctgaggcaggagaatcacctgaacccgggaggcagaggttgcaatgagctgagatcgcactgttgcactccagcctgggtgacagagtgagactgtatcaaaaaaaaaaaaaaattatacagctttacagctttgagtgttctttatatattctggctactggtcctttatcagatatgtgttttgcaaatgtttttcccagtctatggcttgtctttttactttttaaatagtgtgtttcaaagagcagtagttttgtgtgtgtgttttttttttttttttgagacggagtcttgctctatcgcccaggctggagtgcagtggtgcgatctcggctcactgaaacctccgcctcctgggttcaagcaattctcctacctcagccttctgagtagctgggactataggtgcatgctaccatgcctagctaattttttgtattttagtagagatggggttttaccttgttgcccaggctggttgcaaactcctgagctcaggcaaatccgcccaccttggcctcccaaagtgctgggattacaggtgtgagccaccacccccagcccaagagcagtagttttaagttttgattgaagttccatttttcagtcttgtgttgtctgtttttttcagacagggccttgttctgtcacccaggctggagagcactggttcaatcatggctcactgctggcctcctgaactcaagcaatcctcctacctcagcctcccgagtagctggtactataggtgtgcaccaccatgcccagctaatttttgtggttttttttgtagaaacagggttttattatgttgccctggctggtctcaaactcctgaagagatcctcccaccttggcctcccagagggctgagattacaaacgtgagccactgtgcctggcctcaatattttcttttatggttaatggtttttctgtcctatctaagaaacagttgcccaactcaggatcatgaatatttgcttctattttttctagaaattttatagctttagggtttacatttcagtctatgatgaatttccggttgacttttatgtatagtgcaagatacaggttgagattcattttttgaatatagatatatctaattgttccagcatcatttgttgataagacgaaaaaaactatactttgtctattgaattagcttggcatccttgtcaaaaattaattgaccatatatgtgtggatcagtttctggaatttttattttgtttcattgatctatgttacccttttgcctacgctgtctagaatattatagctttattgtaagtcttgaaatcaattggtatgagtactccaagtttctttttttttttacaaaattgtttaggttatcctaaattattttttccatataattttggagttaccttataaatttttgaaaaagaaacgggattttatttgctgtgaattaaaatctatagataatttggaggagaattgcaatactgatgatattgagtcttctgatccatgaacacagtgtatctctgcaaggaagtctttgatttctctcatcagtgtttttgatacttttcaacgtacaaatcttataatactttgttagattgatccctcagtatcacatgtttcttggtgctgtagtaactggtgctttttttttttttttttttgagatggagtcttgctctgttgccaggctggaaaatctcagctcactgcaacctccacttcccgggttcaagcaatcaagcaattcttctgcctcagcctcccgagtaactgggactacaggtgtgctccaccacgcccagcgaatttttgtatttttagtatagacggggtttcaccatgttggcgaggatggcctcaatctcttgacctcgtgatctgcccaccttggactcccaaagtgctaggattacaggcataagccaccgcgcctggccacaactggtgcttttaaaaatttcattttcctgttcttcactattgtgtataaaaatacagttgattttttttatagcaaggcaaggaaaaaaaacaatttctatatattgatcttatgttcttaaactttgccagtcactaattatatctagtagtctcttatagattcttttatattttctggatagataattacattttctgtgaataaaggcagtattatttttcctctcccatctataagtatctgtattttttttctgtaccttattgcattagctaggagttctatcttatatgatgttgagtaggagtgttaagagtggattccctgccttcttcctgatcttagggggaaatcattttgtgttttattattaagtatgagttagctgtaagtttttcatagatgctctttatcttttttttttcttcatagatgctctttaccaggttgaggaagtttcttttgatttctagttagctgagttgttgttgctgttgttttttaagtaatgaagggctgctgaatgaatcttgcactttttctgtacctatagaattagtcatacagatttttccttgtttttgactgctgacactgtgaatggcattgtgtttgacgtatgaatgccgaactattcttgcattactagtctaaattccacatggcaataatagcttattctcttgtattttatggataaaaatcatggataaaagaaatgaagtaggtagcaattccttaaccatatgtgtgttttataagtcatagaaatttttccatcctaagggaagtgctaactcccttgcttagcatacaatacaggtagcatgtttttggttcctcttcgtttggtcttttaggctatcaaaagtgagtggggggaaatgtaacaaaaatagtatgtactaggcagtgtgtatgtttatcttatttaatctcacttgatggaaagtgaggtccatcaaacaatttgtaccaccaagtcttggagctagtaaatggcagggtggtgggggggcggtcagaatttaaatgcaggtgttttggataaaaccgttattagctcactgtatggtatcgcctctctttggaagtgagtgggtatgtgtgtgcatgtgtttgtgtttgtgtgagagagacagaggaagggagggaaggacaggaattgggagagtgaggtagaaattgagatttggaaggagagaaaagccctcccacctttcattgccatctaaaatctgggcttttagatatcgtgatttgtatctcagctttgccatttacttgatttgtggcacatttgtctctctgagcctcatgttttaaaaatttgaaatgtagaacatttacattgagttttgaggaatacagataatatatgtaaaatgtctcacatagaatgtgctcaatttagtggtgtccattactatcatcattattgatttcctaccattaaatgtattttgtaaatgaaaataatctggttttagaagatggcaaaggagacttagaatgatttctatagttgtttgtttagttcttttgacaaaattgcctaaagttcttttataaaaatggaattcattttgtctacttttcactccttctcaagtcaaaataacacaaggtatttactaaatcagtttgcaaatttggaaaattttaaaaagtactgctgagctgggtgcagtgactcacgcttgtaatcccagcactttgagaggcccaggagggaggattgcctgaggccaggagttcaagaccagcctgggcaacatagcaagacctcatcaaaataaaaaataaagtattcctgaatgctctggacttgcctactggtttggaagtggttatctcagtgtggaggattggagatgccgtttttattttacatggacaacagaccattgctagctaactttagtcccttagcccatgtagatctgacagtttatgacgtgagactgtcttctctaagtgacacaaaccatttcaggttgtttcagtaaggttattttgggtcttacaagcagggcccaagagcttctgtgtgtttcattagtcaagtcagggagatgagaatgagtctgagaaagggcatcagactatcagtgccttggactttgggagggctgttggctccaactctaccaatcaatagccttctgggaattggttcatatgattatttgatttcatagaagtactcttccagccaaaagtgctgcttgacacatgaaaattgtatcttgacaatttttggataataccacaccatcccttgatattgttgaaaatcagaattggtaatcagtatgctttccttctagccatgaagtctttaagtaaatatgttaaacttagagttttattgtagactttgtggttaattatgacctttcttagcaagctgatgtcacaatgtaataagtaagttatgtttctcatatttattcagaagtccaggatgtctttgtgttagggtgatatttaggttttgatatcttcgatttgtctattttccccaattgtatattcagtctgtaaaatttattttactcttttccaattacagtggccacatcttcttatttaattttcaccttactttgtacatcattttagggtaggtcttattgccaccttatgatgaaaaaaataaggctacattttcccaaagatcatcattggacagtgagtccatattcagaagccaattctgatttttgtttatgttctttggattagacctctgggccttgagcttgatctggctctctaaatttcattgatttggttaacattcaaaaactaaatatctaatgactacctttgtcccacagttaggatcaacaaatgtgattagatgcctgtcttcaaaggagttcatgaaataaccagtcggcaagaggcaaagtttgggaatagtttcttctacccttcatacacataaccatctctttctagattgatggagagggttccagtgtccaagcaggaatgaccaggcttcatgaaacttttgagtggctttaactaaaatgttgggccatgaggtgaggcccaaccttgtagatttagtggggcctcttgaggagctacttcgtgttaaacactattctaagattaaagcaaaacaagcaaaaaatatgatttcatccttcaggacctcacaagctagcagacaagatggaagcatacatagaggtgcttccaatttctgctttgccctgtccacccttcgttctgctagcagaacagttttttgaaaaacatgccctttccttgcttaaaactttctggtggctccctgtttctcataggaccaagttgaagtttcttatcaggacatacaaggcctccactgatttggcccagcttcttctacacttccacagcttgcttcaggcacataccactccttggggtgcttagaacccatcatgatttttcatacctctgggtatttatttatgctgagctctctgtatagaatgctgtattaatctgggtcctctgaaaaacagacacacaggattaaattggcaagggtttattaggggaaaatgcatgtggaacagacaatggtgagggggctgagaaggctgggagtgccattagtccttcatgcaagtctgagccctagtgaaggggggataggggagagctggttaggcagaaggtttccagacggcagtgcagtctaaagaagattcagaaaagctattggggagtgcaaagtcagctgttagtggagtcctgcaacttccagcaacagtctgctttggtatccctgctgtactcagtgattggttgggagcacccctttggaggtgtgacttagtacagacactaggatgagtttctgaggcagatggggtccttaatcagttgtgctccttgtagttggagacccttgagttgcctcttggcctcttcttggctaccataaattccttttctctttcgttaaattcctcctgcttgtccttaaagggccagctgtaaatgttttttcttccaaaaaacttttcattgaaggaaaatctcagaatgtccatcgtgatcccacgtcctgccatgatcataccataatctttgcttggcaaatttttaatacatttatttgatttgtacccctaccacctattacaggaccaaaaatctgttaggtactcaggaagtgttcgtttgaatgaatgcattggtagggcttggacaggcagatctggggagaaggtagttgaggcagagggaactgcttaagcaaagccatagagggagaagaataaaggatttacactgtagttaataaatgtcttttttccccaaataagtatatcttcccccaaagctgtcattttagagaaagcctattatgatgcaaaacagtgggggaaaggagtgtcttcctggcagttgaaaatgattcatatttgagaactttgttgaacaatgttttgagtatttcctgagagacttctttcttgagaggaaacagttgatggaaatggaattttactgctgccaggaaaagtgcgataaagataaaatctcatgcaacaactactaccagaatagaaatttccatagagcaaagagatttcaaagtctcagctaatggctcatatgtatttagtattcagtgcagctgaactgtaattctgtaatggaatttgaccaattttgagaagccagtttgtaatgtatgaattagtggagacccatacatcttgacgtttgctgactctgccagatgttggttatatttctgatggaaagaaacagagagctggctgggatcccaaatcttagaattgctaccggccgcctaccactgccacatgttgcagtggtaggagataaacatgctgaggataagacctgaaaaaaaatcactctatatcagcaactggagatacagcccatactccttatgaaatattctactctcgtggcctgggttgaaccatgtatgaggcaggcactccttttagcccaggcccaagtctgctctatgcagtcttcctcatatcttgtttccctagagttaccacttgaaggcattccttattcgtaatgtggtgatgattaatggcacctacctcatgggcttgctgtgaggtttcaatcagataatggatgctgaaggcttagactgtgcctggcatagagtaagtgctcaataaatggtagctagagttcttttattatgcaatagaagcaggactctgagggtaacatcttaatatttccagttgaatgttatcaaagtcagttgttcatgcatttgttaaattatgggccatagcaacccaactctatggacctgggctgctgtgtcccagactgtaattaacacacagttgcttatatctgtcttttcttccaagtgaggacagtttgttatgacttgtagattaagcaaaattacttgcttctccattgtgtgctaacctggtgtagaataccttttcttgtctgtcttatttaccatctctcttactttcaaatttctattataattctcctttagattacatatagctaacttaagaaagtcccagatgtgaaaataaggcgagtgcatgatgtatcccccttcccttgatttttgctgatcaggtggggaatctgacccaatagctcttcttctgtatcctttcttccctttcagtggagtagttcacatgggatattatctcctttacttgtcttttactactaaaacatttcttttaaccatcttcctcctttgttttccaagttttgcctgattacatcaagaactacctcctcctcctcctcctcctcattctatcccatttgaaagccaaacacatgaattgaattgtaaatggtaggaaatagagtattactattgagagatgtgtaccaaggcaaaggaaagccatacattaaaatgagcaaggggaaagtagtatttgaattcccaaagacatctcatactcactatgtccaaatctgaaatcactctctatcttctttaagccttctcctgctaaagtcctctggaactttgtggcagcctactctcaagatgtttcaccagtgggtttatttcattcttcttactcctactattcttgctctgggcctggccctcatcatctttcatcttgaggtaataacttctttcctcatctttttgtaccctctctgccctggatggcctatatagtggcaaaagaaggtgttttttttttctttcctttttagcttttttattgtaaaatgagacaagaatttaaaaaatcaaacaaatgtgtagcttaatacaatattacaaggcacacatacttgaaatcaccatccagatcaagcaatagagctttgtcagccaccccagaagtccttccaggtgccctctcccagtcaaaaaccttctctccttctgaaataaccattatcctgacttttaaagtagttatttccttgcatttctttatctatagacagtgctatttggaaacaccagtcttgctgcatccagttgcctctatgccaaagtctagaggtgcgcaaattccctaatgggtattcttttttgaaaaattattttaaaatatttaattgacaaagattgtataaattgaaagtgtgcagtgcaatgtgatgatttgatatacatatatattgtgtaatgattatcacggtcaaattaattaactcatctaataccacccatggtgtacattagagccccagaacttgttcatcttctatctgaaaatttgtgccatttgattattttcctatctcacccccttatctctggaaaccactctttgtttctgggattcagcttttctaggattccacatataagtgagaccatatagtatttgcctttctgtgtctggtttatttcacttagcataactgtcctctaggttcattcattttgttacaaatggcatgattttttttttgtttttttaatggtgaataatattccattgtgtaatatataccacattttctttatccatttatctgttgatggatacttaggttgtgaccatatcttggctattgtgaataatcctacaatgaacatgggggtacagatatcccttcaagatactgattttatttcctttctctccggccctcacaggttttctcaggcctacatttatagtctcctgttttgttttgttttgtttttgacatgaggtcttgctctgttaccaggctgaagtacagtggtactatcgtggctcactgtagcctcaaactccccaggctgagcctcctcccagctcagcctcctgagtagctgggactacaagtgtacgctaccatgcctggttactttttgtatttttttgtaggacagagtcttgatatgttgcccaggcttagtctcctttctatgattccccctcccctccccctagtctctgtccgtaccacgctatttataggctgctagatacctcaggtacctcttggtgtttgccagatgcctctaggtattggctcctgttgttccctttctgaagctgccgctcttccattcactggtgaaatcctagacccaactcaaatgtcatttcttctgtggtatgctgccctggatcttccttctctgacgtacctggggtagaacgaattcttcccgtccctgtgttctgtgtccattatagcattttacacttgcttctattgttagcatttttcagtctttggtacctaacagattttttgtaggtgctcaataaatgttctttgaatgaatgaatctatgtaatccatagttaaaggtctttcagggtgtcagattttcttcagaatcaacaaaaatatcttgttttgattttcacacaaagttaaaaacatattaattttattttctgtccgtaactattattgccaatatttggctttactaactttgtgtgataaatatttgctattttggccacattattggtaaaatagacctttgtgggcttttctggctacctgcacaccatttttattatttcaagggtaacaataattattgagtacaacagtgtgccagacattgtgctaagctttgtctgtgcattatttgctgactcatcaccctaatcctttattattttcattttacgtgtcagaaagtaaaacttagagaagttaaatgagttaaagttataacgctaagaaagggtagattcagggtgcaaatctaggcagtctgactataaatgtaaaacccattttttttagccattatttttttgtttgttttttcctctttgagacagagtctcacttgctctttgtccaggctagagtgcagtggcatgatctcggctcactgcaacctccctcttccggtttcaagcgattctcctgcctcagccttccaagtagctgggattacaggcacgtgccaccacgcccacctaatttttgtagtttttggtagagacggggtttcatcacttttgcctggctggtctcgaactcctggccccaagcgatccacccttcttggcctcccaaagtgttgtgtttacaggcatgagtcactgggcttggccgttttttaccattctgtgttatttcttattaagaaagataatagttctcagtagccaacagtggacttttgcaaagcatctgtggagcacagctcatttgtggaagtttgctacccactgccgcactgggacgcaagtcaattctttaacattttcattcccccttccctaaattgcttctgtgcaaggccctgtccagctctactgatactaggtgtgtatatcttgtggtgaatgggtggcagcttggttaatgactcttggtgagccggaaataacaaggttgctcttatattgacatgtctcttcttagccgcatatattatttagcttacggctactgtcttaagggttatcatcactataaatgatgtgttttgtgcctggcaaggtcataagttgtgtcttctaaaatgatattggtcataaatgttaattgctacttcttaacttccctttgaggtgttacaaggaaatccacgtatgaacaactgaggaagcaattaagcagaagaacagcagcacaggaaaatccaatagttggtactgcacataggcccctgggcttacagaaactcagaccaggggccccagaggaattgcctttgaaatagcagcagtggaggctcagccatttggggaatcattgatggtcattggtagatggcacagacgaatgaagtctagtctcacatgagtgtttgtcctgtttccctcattagcatgtcacttttccaggtcagaaattgtagtctctctttggttgagccctgtgccccttaatactgcccagtcctgcatatggcatagatatggcattgttcacctgcaggcatttcttgtctattttaaataaccctcttactgcattttggttttttaagtcagttttccatttaagcaaattgccaaggtttatctagaatttttggttgtgtaaaacttagctgcagcagctaacattttctgttcctctagcaaatgccaggtgctgtttaaaacactttctacatcgttacctcctggagtcctctcaaatcctttgaggtaggtactgttattctccctgctttctagctcaggattaaaattggcatcacttgcagcttagaagatttcttgttataaataaagaaatgtgttagggagatgtggtgatgcccacctgtggtcctagctacttgggaggctgaggcaggagaaacccttaggctcaggcgttcaaagctacagtatgtgatgatcttgcctgtgaacaggcactgcacttgtgcctgggcaacatagttgagatcgcatctcaaaaaaaattgttgtattgggatttcagccgcactttctgcctaaggtactgccttgtttggaaagggtacttgacaaacatctgtgtggctgggagggtgcttctagagatagtgatttttctctaggatcagttatataataattttgggaaaaaacacaccatttttgttttgttcttgttagagaagtggctgtagcattttctttcaatggacactttatcaacagcttttctaggaagttttattttattgtttttgtgggggtgagcttcaagactatatttgctgttgtttcttttcccagactaccctacttcctactgtagtgtaagtactgtagaaggatttagtaactgaaggtcagcagtttggctcttttgttaattcctgatgctgcagatgaagtaatgtgttttcttgtcagataaaatgtataaggctgctactcagcttgacaggaagaatgagctagaagtacttctcaaagaaaaacgtctcagataacttctgacttttcctttttcacttcctaacgttgttctcctgtatcctgctctactcctaagaaggtatgtgatttgggcaattcatttaatctccctgtacctcagttcccttatttataaaatactgaaaacaagcaggttcctctaacaattttatgagataatatctgtatagtacacatcacagggactggaatatagaaagcactcaataaaccttagctattattagcaaccacttgaatataaaaatgtacacttattcaggggcctgaatgctctccaggttcatgctccaggagtattgtttttttattttttattttttttgagacagggtcttactttgctgcccaggctggagtgcagtggcacaaacacagctcactaaagcctcaaccttctgggctcaagggatctttccacctcagcctccgagtagctaagactacaggtgtgtgccacctcgcccagctaatttcttttttcttttttttttttttttttgtggagatggggcccaggctggtcttgaactcctgacttcaagcgatccgcccacctcggcctcccaaactgctgggattacaggtgtgaggcactacgcctggccaaattggtgttattagtctcaaaaggaaacctaggttgatatcctgcttaccctaaggaaggttcttcagaggtgttttactgttcttggctaaagagcataagaagggcagtaactaaaagaactttagtggccagatgagaaaccaggtagttactggaaatagatattataatatctaaatttgtgcaattttattctgagaatatgacatttggtttcatcttcctacagtggaaccaaatgaatgggtaactaaaagtggtgtgatggagaggattgagtcctaaatttgtgtagtatgctcttccatcaaggattgagattagggggaggaggaggtagtaggtgagggaagaatatttaaataagatgagacatttggctggtcttggaaattgatgtcaagattcatgccccacctgctagtaaagttaatcaagaccagataaatcaggaagcctcactgtagagcagatttcattcattttacctctcccttcctctcctcaaattccccacattgtgtctgattatagccagatatggctgggcgttctaagcctcacctccggagattggtattcactaagtttggcctgacacacagagctctgcattttgaacaagttccctggggatgctcctgcagaccttctcagaagcaccttttgagaaaacctggattcaaattaaggcccacatatcgccataattggtcagtctggaattagcattgagttttggcatctagccacacacattcacttgtcctcttgcacttttgccaaaatgggaacaaatgcatttctctttagtttgggaaaatcaactttttatattaatgtggttgctaataatagctaacgtttattgagtgctttttatattccagtccctatgatgtgcactgtacaggtattatctcacagaactggtagaaaaacctgattgtgccaggcgcggtggctcacgcctgtaatcctagcactttgggagtccgaggtgggtggattacctgaggtcaggagttcgagaccagtctggccaacatggtgaaaccctgtctctgctaaaaatacaaaaaaaaaaaaaaaaaaaaaattagccaggcatggtggcacacgtctgtaatcccaggtactcgggaggctgaggcaggagaattgcttgagcctgggagacggaggttgcagtgagccgagatcgtgccattgcactccagcctgggtgacagagcgagactctgtttaaaaaaaaaaaaaaaacctggttgttttctatattctgtaaataaggaaactgaggtgcagggagataataaatgagttgcccaaattacatagctgcttaggagtagagctggaagtttatccaaacaacctacttgaacctgtactcagtttttgttcttaattggtctcgggtgcatggagttgttggctgcactttaactgctacactgcactgtctttggagccaatcaacttttttttttaatgtttcagaaacaagccaatttacttaaaattttttttttttaaattgtagtaacatacatgtaacgaaatttaccatcttaaccttttttttttttttttttttttgagttggagtctcgctctgttacccagcctggagtgcagtggtgagatcttggctcgctgcagcctctgcctcccaggttcaagcaattctctgcctcagcctcttaagtagctgctattacaggcacccaccaccactcctggctaatttttgtatttttagtagagacctgtttttgccatgttggccaggctggtctccaactcctggcctcaaatgatccgcctgcctcagcctcccaaagtgctgggattacaggcgtgaacccccatgcctggcccatcttaaccatgtttaagtgtactgttctgtggcattaactgcattcacactattgtgcaaccatcacaactctccatctctagaactcttgtcatcttgcaaaacaaattctgtattcattaaacaataaacttcccgttttcttttctccccagcccctggcaaccactgttctactttttgtctctatgacaaagccaatcaatttttgtgttaagtgtataccattaatctctacagccagtagctttctattgaattttttagataaaaaaatttacaagtcaaaccaggatttataaacatatactcagtattgaaacaagaagccatagacattttaaatagaatttagcatgtctttaaaaatgtgtaattgtatcttttaaaggacttgaagtctgctccactatgtaatacaactagattaatatttgataacttacacataagaaagctgcactgaaaggaaaaacaagccctattgctgggtggttcctttatgcttgagaaagcagtttctttggaaaataaatacatttgtgatcacatgaattaatgcaaattgctgcatcaggctaaaaatccattatgctcagtaactttaatgagattgtacattttgggatgctttggacagagcaaagcaatacatattaaaagggctgattttgaaagctgaagccccacttttcctcctgtcaattttttttaagttgaattgcctacaggttactaatatttagaaagctgatttgcgaagctggaaaccatcattctgagcaaactatcgcaaggacagaaaaccaaacaccacatgttctcactcataggtgggaattgaacaatgagaacacttggacacagggtggggaacatcacacaccggggcctgtcgtggggtggagggagcggggagggatagcattagggagatatacctaatgtaaatgacgagttaaggggtgcagcacaccaacatggcacatatatacatatgtaacaaacctgcacgttgtgcacatgtaccctagaacttaaagtataataataaaaagaaagctgatttgtgtggttacacaggtataatagttttatttcaagcttttgaagatacagttccacccctccccccccccacatttttattttatctttctgggaaaatcctgaacctagaagcttcttttataaactttgttctgtgtcagatcattaatttgtaagcttgatgtagacaatttcagatgctgttattattctgaaatgtactatggttgttatcaatttttagctgtttacacaaagcattattatgttttaattttttaggctatcttaaaatacctgaattgtgtcagccaaatagggactgaagggtgctttataataacttaaaacttagatccttttttacctaatgataaaatcagtaggagtgtattttttcattcagggtcatctgtctctttgattctctttcatttacattgtatgtaatcaggatatatatgattttaaaaatttgacaattagtcatgaggatttgttttaaaattaaaaagtattatatgtggttaaaaatttttaaacaggtcgggtgaggttgctcacgcctgtaatcccagcactttgggaggccgaggtgggcagattgcttgagtcctgtagttcgagaccagcctgggaaatgggaaacatggtgaaaccctgtctctacaaaaaatacaaaaaaattagccaggtgtggtggcacacacgtgtagttccagctactcaggaggctgaggtgggagaatcacctgagcccatggaggttgaggttgcagtgagccaagattgcaccattgtactctagcctggacaaccagagtgagaccctgtttcaaaaaaaaaaaaaaaaaaaagcgggggtggccaggcacagtggctcatgcctgtaatcccaggactttcggaggccgaggtaggcggatcacttgaggtgaggagttcgagaccagcctggccaacatagtgaaaccccatctctaccagaaaatacaaaaattagctgggcgtggtggcgcacacctgtaatgccagctactcgggagctgaggcatgagagtcgcttgaacctgggaggtggaggttgcagtgagccgagatcacgccactgcactccagcctgggcagacagagcaagactccatctcaaaaaaaaaaaattacagaaagtgtaaaaaagtttatatccacacttcattcaaagccctgttcagtttcttatctagactttcatatggtttttatgtcagtctaagtacacacacacacatatacacagtgcgtgtatcttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagcagagacggggtttcaccgtgttagccaggatggtctcgatctcctgacctcatgatccacccgcctcggcctcccaaagtgctgggattacaggcgtgagccaccgcgcctggccgcgtgtatctttttatacacagaagaatcatacaattcttaatattcaatttagtttttaacttactatatattacaaattatttcatatgggtatttacgtagctactcataaatagatgtcccacagtattccaatgtttagatattccgtagctcatttaaacagtcttctcctgagggacatttggattatttaatttgtttgttttactattataaacagtgctgtcaacagacatccttctacatttttgtttactcatgtttgaggaatcacataaaaacttttttaaagaaaaattggagtaatgatattgaaagtttatacattttgctgtttgatagttcctaattttaaaaaagccagtgtaaaaataacatttggaacaataaaaatgaaaaccagtatcatatacttgaacatagataactaaacatacgtgtaaatattttgaataattacagctatcatttaatgatcaccaatgtactgtatttacttctcacaacactatggggtaggtactcttttaaaaaatttttaaagcagctttattgaattataattgataaaactgcacatatttaatgcatacaatttgatgagtttgtacatatgcatacacccatgaaaccactacaactaaagtaataaacatatctattgcctccaaaagtttccttatgcttcttctggtttgttgttgtaagaacatatgacatgaagtgggatcatacagttatttgtttttctgtgactggcttatttcatttagcaaaatgtcttccaggttcattcatgtcacaatgggaggatttccttttttaagaccaaatggtattcattgtatgaatatatcacatttccttttttttttttttttttgccagtctagttttacttattatctcttcatttcccacgttcaccttcccagaacttattatattatattattattattattattattattttgagacagagtgtttctctgtcgcccaggctaaagtgcagtagcatgatctcagctcactgcaacctccacctcccaggttcaagcgattcttgtgcctcagcctccccagtagctgggattacaggcatatgccaccatgcccagctaatttttttttttttttttttttttttagtagagagggggttttgccacattggccaggctagtcttgaactggcctcaaccgatccacccaccttggcctaccaaagtgctgggattacaggcgtgagccaccgcgcctgcccccataactaattttaaacaatttctaaacatcatatgattctattcataaacacttcagctatcattattatttaacataggaaatattaacatatattatgggtacaaatgctataatatttaaagcacctttatgttatgatattaaatgtaaatatttgtttaaattcctggctttccttggttcatcaaatcaggtaataaattaaccagacaggttccaattcaatcagatacgaatataccacgttttctttatccattcatctgtcaatggacatttgggttgcttccttatcttggctgttgtgaatactgcttcaatgaatatggaagtacagatatgtcttcaagattctgattttaattttgtggtgatacacccagaagtgggattgctggattgtatggtaattctatgtttaattttttggggaaccaccatactggttttcatagcagctgcaccattttacattcccaccaacagtgttacaagggttgcagtttttccacatcctcactgacacattttatcttttgatttttttgataatatccattctatcaggtctgaagtgatacctcattatggttttgatttgcatttccttgatgattagtgatgttgagttccttttcatttacctgttggccattgtatgtcttttttggagaagtgtctattcagttcctttgtctattttttaactgggctatttggttttttgctattatgttgtaagaatttcttttttgttctttttttttttttgagacggagtctggctctgtcacccaggctggagtgcagtggcatgatcttggctcactgcaacttccacctcctgggttcaaacaattctcctgtctcagcctcctgagtagctgggactacaggcgcaccgccaccacgcctggctaatttttttttttttttgtacttttagtagagatggggtttcaccatattggtcagactggtcttgaactcctgacctcaggtgatccacctgcctcagcctcccaaagtgttgggattacaggcttgagccaccgcgcctggccaggaatttcttatatattttagatattagccccttgtcagatacatggtttccaaatattttctcccattccataggttgcctattcgttctgttgattgttttctttgctgtgcagaagctttttagtttcgtgtagtcctacttgtgtatttttgcttttgttgcctgtacttttggggtcatatgcaaaaaaatcattgccaaaaccagtgatttatttttatgttttcttataggagtttcagtttcaggtgttacatttaagtctttaatccattttgtgttgattttcatgtatggtgtaagataaaggtccagtttcactcctttggatgtagatatgcagtgtgtccaaaacagctcattatcatctccactcataaatctggtttttctgtattccctttctaggtgataatgtccccatttactctgtcatttaagcaatacacctctaagtcttttcagttctttttttaatctctcttaactccttctcctcttccattctcatggctgcagctttggtccaggccctcaacagttatcacctaggtaaatacagtcatatgtgccccagtgtagcttgtccagccttgcctcttgctatctttttcctcatatgtttttcttcagcaataggtgaactccttgtgggtcactcagtcaccccattccatctcctgcccttgggcctttgcgcatgctagctgctctgccagatcctccctcttacttcttagcctgtttaacccctactcatctttgaaaggcttgcttcaggcatcacatctaggaagtctctgctgacccctgagtttgggcttaggcactctttttcctcacacttgcctgtagctcctctgatgttatattcaccacactgggttataatgatctatttgggtgcctgtcttctcttctggattgtgaattcttggagactgcagccatggggaaatctattgcatttttctgtgtgtgaatgggagtggggtctctcctttagtcataatgtgtccttctcagggaggccttcctttgtaaccctatctaaaattgcaacctcccccaacacttcctatcccccttccttgatttattgttctccttggcacttattgctgtctaccatactatagattttacttatcttgtttattgtctgtctcctcccactagaatgtaagcgctatgagggaagggatttttgtctttttttaaactgttgtgttctcactgcctaaatcataccaggtatgtagtaggcacttagtgaatatttgttgaacgattcaacaaattcagctgcctctgatagtaaattttgttttgttttgtttttgaagacagggtcttgctctgtcgcttagtctggagtgcagtagtgcaaacacagctctctgcagcttcaaactcccaggctcgagtgatcctcccacctcagcctctcaagtagctgagattacaggcatgcactaccatacctggctaatgttttttgtattttttgtagagacagggctttgccatgttgcccaggctggtctcgaattcctgagctcaagcaatctgcttgtctcggcctcccaaagtgttggatttataggtgtgagccaccatgcctcgccagtgtattgttaagagtgtagtgtttggagccagactgttagacttcagattcttccggcgtctttttttttgtttgtttttgaaacagggtcttcttctgtcacccatgctagagtgtggtggcacagtcgttgcttaccacagcctcgacctcacaggcttaatgtgatcctcccacctcagcctcccgagtacctgggactacaggtgtgtgccaccatgtccggctacttgttttattttttgtagagacggggtttctccatgttgtctagactggtctcagactcctgaactcaagcgatcggcccaccttggcttcccaatgtgctgggattataggggtgagccacgatgcctggcttcctgaagctttttatctgtgtgatcatgggcaggtcacataatttctctgtgtctcagtcttttctgttttttttttttttttttttttttgagacagagtctttctctgtcacccaggctggagtatagtggtgcaaccttggctcactgtaaactctgcttcctagattcaagcgattctccttcctcagcctcctgaatagctgggattacaggcgcgcatcaccacacccagctaatttttgtatttttagtagagacagggtttcactatgttggtcaggctggtctcgaactcctgacctcgtgatctgcccgcctcagcctgccaaagtgctgctattacaggcatgtgccaccgcgcttggcccttttctgttttaaaatgggactaatagtcatctttactgcacagagtaaatagttctgtataacatattacaagattacctggtatgtggtaaacattgaaaaagtattacttgtttttattcctgacttggaaagttggccttagagatgtgtttatcttggcatttccagagcctggcctggtagtgcacacctgaaagtatcaaataattctttgtaagataaatgtttaaatggaatttaagcagatttttcaaaactattgtttttgtcttatttatttatttatttattttttttggggacagggtctcgctctgtcacccaggctggagtgcagtggcacgatctttgctcactgcaacctccgcctcccgggttcaagcgattctactgccttagtctccgagtagctgggattacaggtgcacgccaccacgcccggctaatttttttgtatttttagtagagatagggtttcaccatgttggccaggatggtctcaatctcttgacctcgtgatccgcccgcctcggcctcccaaagtgctggaattacaggcgtgagccaccacgcctggcctgttttgtcttctttaaattagtgttttggatttttgataattaatcatagcagtttgtatttaaattagatatgtgaatacctaaaggacaaaatcttaaaacatcctgtttttctttttttgagaatctcacgccattgcccaggctagattgcagtaacgtgatcatggcctcgaccttctgagcttaagtgatcctcctgcctgagcctcccaagtagctgggatcacaggcatgtgccaccatgccagtttaattttttttaattttaattttgtagagatgaggtcttgccatgttggtcttggactcctgggctcaagcaatcctgcctcagccttccagagtgctgggattataaacatgagccacagtgcctggccttaaacattttagacaaaaatgggaacttttgagctttgactttgattagacacagtaagcgcactcatgttctaaggctagaagctcctttaattttctgtggaatgtggatactgttgtagaattccaggctgtgcttaagctagtggatctgttccactttttaactccttgcttcatttttaccagctttagagccctatgtctttgtagccaagaaagaaattagtctaggcctgtaaagactcacatctagttaagatagacaagtcttcagttttcagtaatatgttgcaaaaaaggcagaaaactactcatcttggtttcttggaaagtgaaactgtatgtgtactaagctccatctgtcaaaagtagtatttaatactttttccttagcatcttttcagaaaatgggagcgtgggtgatggtgatggaaattaacatttacggagtgccaactatgggccagacactatatgtatgttattttgtttaaaccttataggaatattgtatgtcccaatttacatataaggacactgaggcacagaatggctaagtaacttggcaaagatgacatatcttgctagtaagtagcagagccagtgttttgatctaaaatcttttttactgtcactttccacatctgccacacacttgaacaagaaaatgtacagttgtcattcatcttgaatgttgataatttgtcttattgtcaggtttttgctactttcaaaaattggcacaaaggtaaaagaaccttgcatttcttgaagttgagaggtttgtggttccatttgtaagaagttaaatcctaaaaatacactgtaaagtatactaaatgagcaaattaagcattaatagctgtaaaactgtacatttatattatacatactgatttatgtaatatataaactaaaaattagaggtgtgaaggatccttaatatggtcacatatgtttcagttatcctaaaatactttttttgctaatactcttttcgtttttcttccttttttattttttgaggcagggtcttgctctgtcgcccagactggatggagtgcagtggcttgatctcggctcactgcagcctcaacctccagggtgtaagcaatcctcctacctctcagccttccaagtagctggaactacaggcacgcaccaccacgtccagctaatttttgtactttttatagtgacgaggttttgatatgttgcccacgctggtctcaagctcccaggctcaagcaatccacccacctcagcctcctacagtgctgggattataggtgtgagccaccacacccagcccactaatacttgattcttaaaaaatattttaagaatgttttttcttatggcttcaacattctttggaaatgtactttccatcagtaaaatgttcctagtttctactctaactctggagcagtatttgtatgtgtcatcaattgtttaaatttgaatcaagcatcagtaatggcataccatttgggctgctttgtggccctgatgaatgctattttattttatttattttttattttattttaattttgaggcagagtctccctctgtcatccaggctggagtgcagtggcccagtctcggctcactgcaacctcctccccctgggttcaagtgattctccttccttagcctcccaagtagctgggactacaggtgcgtgccaccacacccagctgatttttgtatttttagtagagattgggtttcgccatgttggccaggctggtctcgaactcctgacctcaagtgatctgcccacctgggcttcccaaagttctgggattacaggtgtgagccaccacacctggcctgtgaatgctattttaatatagttctcaggaatgattaaaaacaaatgtgtttttctaagtggtagaattaatagataaaatcactttgaaattaaagtcctcaggtaacatagaattcttttccctgaacaagtcattatgtagcacatggtataattttggcagacccaactttattaccaacaaaactgtaaagcgagtcctatgtcctgtttgtcttttcttctcgggggtttctgttcttactagaacaaatcaaagtacagtgtgtgttgctggtcttcaagaattattagtttttgttgtaactgtttaatgcagaaacagatgctagagcagttattccccaaggcaccatgtgcctaaggcatttttaaagcactagtatgttttcagtgtgatactgctactctggaagaactgtatacatagtggttcacttttccagtgtggttagaactgacatttctaagatataaagaaatttaaggccaatttggatttgtactctggctctgcttcctgcttaggtggaagactttgagtgatttagttatgctctctgcctctattttctcctcttcaaagtggggatgatgaaacctactttataactttgctgtgaggatttgtttcggaaaaactctcaaatcagctctgctctcacaccaacaacacaacaacaatcaacacagaagacttccgtgacaaaatgtggggattttttccaatacactaagcagtgaacaccagctgtgtcctctaattcaattttgacaccatctttctggagatagcatcagatcccacaggtagagggcgcagtccccaaaattgccccctctcccaggcaccagttccaagtctgggcctctgcaacttctgaccgaggagcttcaagttgaggttcccatgaacctctccttgggtttgattactttgccggagaagctcacagaactcagggaaacacatttactggtttattacaaaggatactgatgaaaaaatgtgtagggcgaggtatgggggaaggagagtggagtctccatgacctccctgggtgtaccaccctctaggaacctacatgtgttcagctatccagaagccctctgaaccctttctgtttgagtttttaatgtattttatctaaatacaaccatgtagaaatgtgattggacaaaaagctcatgatctaaacccagcaaggcttgtctgttcagacttttcttggctactctgtgtagcattccttcccttagggtatgggacagggtcctctttggaatgagtgtctgttgataagagtcttcccttgggcaggtgaaaggaagacaggagagggtcagagagatctgtttcctgaggcctaaagtgccccaacattataacaacagattatgacaagggttatggaagttatgagctagaaactgtggatgaagagggtgtgtgtgtgtgtgtgtgtgtgtgtgtgtgtataacaggattattatctaggactacacgaatttgatttgtgcatttgcttaagacagtgtaatactgtgttaggtatgcaggcttgagagtcagtccattgagatacaaattttggcttcgctcctttttagtcacctgaactaggatcacccacataacctctttgtgcttcagtgtcctcatctgtaaaatggggaaattaataactacctacatcacagagttgttacaaggcttaaatgagtcaatacatatgaaatgctttgaactccacctggtaagtcttcattaaatgttaaatattattaatttctttaatattgttatctccacttgtcagcatgctatgtcaacattcattcactatgttcactaaactgagacttccttgagaacttggccaaaatcagtatttgtatctcctgaacctgacatatttgtacttaatttaaaatgtttatgaaatgaataaaatagtgagggaataccttcatgcttctcagatctactctttttcttctttccatttcctttgaaactaatctttctcacgtgactcatatcatatttgaagctggactgtctatgttttctagaacaaaaatttgggatacttggtctaaaaacagattagtcttgttaaggctgccgtactacttatcacagtcccatattctgtgtctcattagatgtatttctcctctcctacttcttcctctctggtccccaacacacaatgtagagtctggggcattggggcgtagaaatgcttgataaatgattattgacttgagcaaagagtctacaggggtgattcagggcatgaattaaccttcctcatgctttgatctcagatggaaatagagctgctcattcacaccagtgatggtttcaaggttattaggagctgcggtatctgaatctggcttctttttatttttattttttctgagacggagtctcgctctgttgcccagactggagtgcagtggtgtgatctcagctcactgcaacctctgcctcccgggttcaagcgattcttctgcctcagcctcacgaatagctgggattacagatgtgcatcactatgcccggctaatttttgtagttttagtagagatggggtttcaccatgttggccaggctggtctcgaacttctgacttcaggtgatccacctccctcagcctcccaaagtgctgggattacaggtgtgagccactgcacccagcctgaatctggattattttgaagtaacacatttcgaacctcaaatgaggtacaggatatatgagacccagaaacaggcatttgaaaatattctgctttgtaaaattagatatccgtgcttttcttcaagggtattcttttctcctatctcttaaaacctgtatatctgtttttttaaattttctatttcaagtcctcaaatggtaaattagattggaaataattcattggtaagttgcagtcactatgcaaggagagttggcataaatggtgcagttttactcttgctgcatctctctacctatagcaacatagaaatatcttttctaattatagtcatgaaaagtctaatgaactctattctgttttaaaaaagccttttccattttcttttgttaagcactttcttttcttttttttttttttttttttttgagacggagtctcgctctgtcgcccaggctggagtgcagtggcgggatctcggctcactgcaagctccgcctcccgggttcacgccattcttctgcctcagcctcccaagtagctgggactacaggcgcccgccactacgcccggctaatttttttttgtatttttagtagagacggggtttcaccgtttttagccgggatggtctcgatctcctgacctcgtgatccgcccgcctcggcctcccaaagtgctgggattacaggcgtgagccaccgcgcccagccaagcactttcttttcatttgtgccatatatattgttgaaaattggcatttatatacccttctggctttaaacaattggttccattttccatgtaactagacacaaatgcattatgcaaaattgtgtttgtaaggagagatcatccttcattccgtttcataaaggttttctcttttttactgtttacgtgagggttgaatatgtctgccttctggtaacacattaaggttgcaatatttgtctagttgtaggaatacttagctcttttttgtttgaatttgacataacacatgggtaaatctaatcctgatggaaagttccatttaatttttttataacaacttttaattgacacataatgtatttatggggtatagagtgatatttcaatacatgtatacaatgtgtaatgatcaaatcagggtgattagcatatccatcaccttaaacatttatcatttctttgtgttgagaatattcaacattttctcttggctatttgaaaatatggaataaattattaattgtagtcaccctacagtgctatagaacactgtaacttattcctcctgtctagcagtaattttgaatccaagagccatccctcctgcctatccttcccagcctgtagttgccgctattctgctctctacttctatgagatcagcttatttagaaagctccctttttaaacacataaaaatatttttgtagtgtaaaaccaatatatgtacactgtaaaaaaaagtttgtcttaatcagcttaacatatgtttgaatttaaaaaaaatgtaattatcttaaagtttcagtttctaaaatcaaagtaaagtactaataccagtgcttcctcatgtatactcggttgagtttcttttgggggtgatgaaagtgttttagagttagattgtggtgatggttgcacaatgctgtgaatatgttaaaaaccatggtattattaaatgagtgaattttcatttagtatgtgatttattaataaagctgttttatgaaaagggtactcatatcactatgaatcagctctatcacttagtagctggctgtgtaataaccttggattaagttgctttcatttttttgtgccttggcttcctcatctgtacaatggggataataatatcttttttgttggttggttgtgaggactaaatgaataaatacatgcaaagagcttagaattgttttttgaaacataaaccctcaaacgtcagtggttgttattattcttatattgcatgtatagttcagaagagaagtctggggctgtagatacacctttttggtgtgatcaacataaagatggtaattaaagccacacatgtggattaggaaacccagggagaacatgtagaatgatgaaggacagagagctgagagccaaatctagagaaatagcatcatttaatatgggagcaggacaagcatatctggcaaaggaaactgagaagtcatgtccatagaggtgagacaggtgtagtgttagggaaggaaaggaaaaaattgtcttccaagaaggagaatatggctaatagtgtcttgctaaagagagtttatcttagtctaatttgtgttgctctaacagactgggtagttcataatgaaaataaattgatttcttaccgttctcaaaggccgggaagcccaaggttgaagggcctgcatctgccgaggtccttcttgctgagttgccccatggcagaaggtggaagggcaagaaagtttgagagagcaagagggcaagagcaggagggagccaaattaatttttataacaacccactctaacaataatctattcatgagggcagagcccttatggcctaatcacctcttaccatcctggtcccacctcttaataccatcatagtggcaatcacatttcagcatgagttttggaggggatatccaaaccataactttctgttcctgaggccctgaaacccatgtccttctcacatatgaagtatattaattctaccttaatggctccaaaagtttttttttttttaatttaaaaattttctttttaattctcagcaaggcaaggtacttctatatagaagggtgcgcccttacagatggaataatggtgagcgtacacttggacaagggaggggaaggggttcttaccctgacgcacgtggcccctgctgctgcgttgttcccctattgggtagggttaagaccgcacaggctaaactaattccgattggctaatttaaagagaatgacaggatgagtgctttggcgggaatcagggcagagcaggtagcaggtaatcggaatgagttagagtggagcaggtgatcggaatgagttagggtggagcaggtgatcggaatgagtcagggtggagcaggtaatcgaaaaagattctttacgaggaagttaagtttaaaagtagaaggaaaagaattgaacacactgacatattaattctttgaaaagaaatttagaactcatatctaacagcccctccccttgtatttccttacagctttcttttcaaacttttaacatgtcttagcttagttgttttgcttgattttctaaaagaagaagcttctctggataaggtggaggatagttaagggaggttttagtaagtgctatttttatgagcctctgcatcaacttacgggtgcatggtatgacacagcacccgacaagattaagtacactcattatggctgtgagagaaataagaattgaggctattatttctttccgtttaccgaactacttttctagccatcctgtaaagaggtcatttacccctgagttgctggctgactcattggatagagcagtcagaccttgcaatgcctttgttatacttccattaggggtggtggtgtttgggatgaagtgcaacattgagttttaatcatgatgcaaactcctcctctttctgctaatatcatgtctaaggctgtcctattttcccaagccatctggctagtagcccctaattgttcagctattcctttaacagcatctctagtgtagttaataaatcactgttggttgtaatagatgtagtttatccaatctacatttttattaactgtcacccaccaaaatattgacaaatcctgcagctatttgatttcgggctttaaattgatctggtattccccgtgggactccaattgcatctaaatagacgtgagagtcaaaagacccataaggtacttctctcgctttatgatgtcttatttttcctcctcctggttgatgaaatgccagggtgaaagggatagccaattggactaaagcataagtgccacttcagttacttggcagagtgtccagtaaaggtccaccataataccactacacatctgctcagggatgaataaaggctgactgattggtaagcttttgacaattcttaagctcactacatcccttcaggtctccaaggagtgataagtttcctccctgtcaagggagacatgaagtgaacctagtgttgggagacggaagctggatggcccttgggggctgacccgcagggtgccgaacttcaagatatagcagagagagagcttggcacgacttattactctaggctgtagaatcctggaaaagagctaccatgcagtccacgcctggtcgactggaggaccaccctagtggaaaggggacaatctgggcctctggcctgccgtgcgcacaagaataacaattgctttgttaaacgtgtggtcggaatttttgatccattccaaccaggcatttgcatcttggtatcctgtcttaattgccaaagtttgttttaagtctttaacttctatgatcctctcgtaaaatgaatatatggttttaggaaattacaaaaaccaactggggcagtccacccttgctctttagtggtccacagaacactggaccaactacgatataaaggtctacatcggggggcaagcctcctggttgacactggggtctttatcgaaatctccccagattaaatggtcccaatttactaatgtccagtctgaggagagtcaggagggacagaggtacttttctgaagtagagagctgtctttgacttggcaagtccccacagggtttaacaaggcaagcattaaatgcaatagtttgaggcaaaattgacttggttatgttaataactaaatggtcaggaatagagcgaggaaagaagaaagagtaatagatagatgaaagagttaaatttttcttagctttagtttggtagggttttctcctgggactagggcccacaactctggagggggtggcgctttcttgactcgggtatgatgagtccatcccttttttgctgtacgaacagcggtggttagcagcacaaggtagggtccttcccaggctggctcgagttttccttcttttcaccctttgatgagaacgtgatcttcaggctggcgctggtttaccggaaattctaggtgtggtacatgtgctaaaagacttttagttttgagggaaaggaaagtggaagataaaccaagtatataatttctaagaaactgaccttttgttttaaatgtgggtacatcagcagtggactttatagtccttggtgccttcttactgagaaatttcctgtagcacctatttttattagtttttagaccaaagaaagccaaacaccattttatatttgacaatgcttcctgtattatttttataccagataagctaaatttcacctttatattagtgtgttattaattttaaacttagttttaataaaacttatagacataatttattcaatttttaatgtctgaccataaggtaagatttttatagactctttttaaccttttataatttttgttaaagagcaggttagtgctttaagaaaaaccctttgtgtttttattttaatgtccagttcacagaaaaattggatgataccctttcaaccttagccaatatgtttgcatacagtttcctttacaattaatgttttaaaacttgcttaaaccttcaaaacaaatttttttaaccttttaatgtaggtaaaaatccacattcttatgcctccttataatccttttactgaaagtatattttactttgcttatacaccttgcaaataaactgtttctgcaatagttttacattcaggaggtctaattacttttaaattatacaacatttcttgcataaattcctttttataagacactttttttttctttcacggctttcacagacaattcttcgacatgcctcaactttctgacttattgcaaacatccctttctttaagcaaccagttatttcaggacaagaatttaccatataacattctctttacataaattctcctccccccttttttttcctaaaggtgataaccattcttttccaaagcgaacttccttcatatctgtggactagactgcctaaggccataagattagaagttaggataatacatgttacaagttaggataatacgttaacttttagcaaactttacttttgttgaaaactttgtaagtttgggatttcaattatcctttgctgttaataagaccttgtttagtccaaattaacttagaattgatatagatggttccttcctgattctgtaagtactttaaggcttagctgagtggaaacagctcatccatgtttgattagaccaattattaggccattttcctaactctgcttttacaagagtttccctgtcaattactgaatacctattgtgtctttttcactcagtcacctgggaggaaccatctattgtcctgtcctgaagggagttcctcctaggtctggtcagacctttgtgtggtaattaattaagatttagataccctgttaggaaacctgctgcgttaagggaattatccgtcgttaatgttaaatcatctttttctaacagaatagccccatactttaagatttttgagttagtaagctacctttttttttttttttttttttttttttgacttaggatagttctgaactggtgaggtgtgctcacaatcaggtttcctctaaaagttatttttttactttcttctgttagcaaagccattgctgctacagatagaatgtatttaggccatctgcgggttactgggttaaggatttttgataagaaggctacggggttgtccatggcctcagtgctttcgggctacgtccttgtttacactgacaacaaagtggtattggagtgttatagggtcacggagaagacctttaattatcaagtacaggttcctaatttaccttggcttttaaaggaatagggtacactgtttttttcttaactacttgtatatctctctctctttctctttgactttgtttctctcaatctttgactccctctttgtctctctgtctcttcctctgtctcttcctctctctctctttgcctcttctctctcttccccctctctttcttcccctctctgtctttcccctctctctgtctttcccctctctctttttctctcctctctgtctctctttctgtctctgtctctgtctctctctctctgctggtctttccttgcctctgccagccgcttatgctgctgttctcccctctccttcctcttcccctaggggagggactggcgggagtggagctactttttcttcctctaagaagaaagggggggtttgtgtgaggttcaagccttgaaattagcagaagtctcaacccctgaaaccagggatgtctcgccttgcctgtcccaggaggctcaacccctcaacaccagggaagtctcgctttgcctgtctcagaaggctcaacccctcacaccagggatgtcttgccttgcctgtcccacaaggctcaacccctcaaaccagggggtgtcttgcctgtcctagaaggctcaacccctcaaaccagggagtattttgccttgcttgtcctgggaggttgacctgtttccccccttttcccctctgaaggtcctttgcacacttcccactcgtgctgtcctctctggctgctcccctaagggagaattaggcccctgttagtgttggtgtgctggtataaatcccatggcaggatctgccctaagccatatgaggtagctatggaaccatggagaggacccactcactccatcctgcagtaggacttgtcaccatccacacaacaccgtaagcagggttgttggtgatcattcacgcatacacatatttagccctccagaatttgaccaccaaggaagtactttacggctcccgcggcttatccttccttggtctgcgcacagagtcattgccacagtatgtgaggatcctttaagctaggtcgctggccagttcccccccccccccccccccccccccccccgcattgctgagagcttgggttattcctcgcactgggtgggtcttgatttctcacccctgaggccaccacaatagggcagggtgcactgcagaaccagagaccaccccaggaggggaatgtaatcccagatgggcccccaaattgtcacatataaagtttcagtgctgctaaaggaatagcattcgaatatacaattttctttttaattctcagcggtgcaaggtacttctgtatagaagggtgcacccttacagatggaacaatggtgagtgcacccaaaagttgttgggttttttttcttttttctttttctttttttttgcatgataacatctcactgcagtgtcaatgtcctgggcgcaagcgattctcccacctcagtctcccacatagctgggactataggcacatgacaccgcagaagtcttaactcattccagaatcaactccaaatcccagagtctcatctaaatcagatatagatgagagactcaaggcatgattcatcctaatgtgaatttctctccagctgtgagcctgtgaaatgaacaagttatgtgctatcaaaatagcataggttagacattcccattccaaaagggaggaataaccaagaaggaagggataactcatccccagtaagtccaaaacccttcagggaaaacaacattaagttttaaagctaaataataatctcctctgactacatatcctgcatcctgggtacactgggatagagatttggcccccaaggcctcaggcagccttgctcctatggctttgttgggttcagtgcactcagtaactcacaggttggagtctcctacttgcagctctcccaggctgatgctgtaaactaggagctctacagttctggaatcatggtaatggtcccagtcccatatttccactatgcatttccctattgaggactctctgtgctggctccaacctcacatttctacttggcatttccctggtaggagctttctgtggtggctccacccctctgacaagtctctgcctgggcacccaggctgtctgtgacatcctttgaaatctagatagagttagctatgcccccacaactctcatattctgcacacctgcagaattggcaccatgtagacaccaccaaggtttatggcatggactttgtggagcagcagctcgatcctcacctgggctcccttgagccatggctggggtggccatggagtgctgggctggaatgcagggaggagagactctgggcagatagcctgtggagtatgccccaggtctgtcctccagaaccattcttccctcctgcagctctgggcctgtaatgggagggcagcctcaaagatctctgaaatgcctttggggtcttcctccattgtcttggtgattccttttgttagtatgaatctctgtagcaaagggttgcttggccacaccgttggtttgctccccaggaatgctttttcattctgtacctggccaagctgaaaaattaaaaaatctttctgttgtgctttttattttatttatctatttttttgagacagagccttgttctgtcacccagtctagagtgcagtggtgcaatcttggctcactgcagcctccgcctcccgggttcaacaattctctgcctcagcctcccgagtagctgggattataggtgcccgccactacgcctggctaattgtttgtatttttagtagacggggtttcaccatcttggccaggctagtcttgaattcctgacctcgtgatccacccgcctcggcctcccaaaatgctgggattacaagtgtgagccactgcccccggcccctgttgtacctctttttaaattgtaaatttcatctttaactcatttctttcttctcaactcctactgtatatggttaaaaatagccacacagctcctttgatattttgcttagaaatttcttctaccaaatatcctagttcattagttcattgctcttaaatcctgccctaggtcatgcacacaattcagccacattatttgccacttcataacaaggatggtgtttactccagtttacaataagatatttatcttttttatctgagacctcatcagaatggcctttatgtccatgtttataccaacattctgatcatgaccccttaagtaatccctaagaggcctcagactttccccatagcacgtctcttcttccgagccctcatcagaatcatccttaatactccatttatggcaatctaggctttttctaatctgctcttccaggttcttccagcccctacccattacccagttccacattttcagttattttttatagtaacaatcctactctcggtaccacttctctgtctttcttcattttgtgttgctataatagaataccacacatggagtaatttataaataaaagaaattcatttctaacaattctggagggtaggaagtcaaaggttgagggctcggcttctgttgagaaccttcttgctgcatcatcccatggtggaaggcagaagggcaaaagagggcaagagcaagtgagcaagagagggccgaacttgctttcataacaatccactctcatgataaccaacccacttctgcaattatgacattaatccattaatgggggcagagccctcatggcctaattatctcttaagggttccggtcctatctcttaataccatcacagtggcatttaaattttaacatgagttttggaggggacattcaaaccatagcagaggtttaagtaagataaagactgagaactattcattgcatttggcaagttagagttatgggagtgtgggtctatggaccagcctacagagagagggctgaaagagtgaagaggaggtgaggaagtagagatggtatattcttttgaggaacatggtcatttattcaatggttatttattgagctcctaccatgtgtcaggccttgctctagatgttaatggcatgtcagtgaataaaacaaacacatttctgccctgaagaataccactttacattgggcctatagagggaaggggagaagaggctagaaatagggtacatagtcaaggaaatcgtggagttttttttaaaggaaaataagtatttaaatatatttaagttaaggaaacatgggtagatacaaagtagagatgaagtggttgacagtataggaaagacaggataattattggtcaaaaaatatggggagatagagatcaaaacataggtagaggctctttgtgagtcttgaatgggagaagagatactttattctttctcaaactggaaggaaagagctgatgtgcacacagtgtgagggaatgcttcctagatgaccctgattttctaagggatgtaggagcaaggtcacccatatagagaggattgtgataggggacttgagagtcatgaagctttgaaatgagcatttagggtaagtggagagtcagatgaaggaagacaagtggaggtttgtggagtagcactgaagaatttgtaatgacattaattttttatcagtgtggttttaccaaaactgttctcagcctcctacatgcaggaatgaagaaagcagtttgcgagattggtcctggatttagagctttgtaggtaagtcatttatggcaaaaagccaggttgggaaggaattgagagggctagtgagagaataggttccatgaatcaatatggtgttcagagatcagagggaaagtgtagatgaggactggtaagggctttgagaaactgagggtagagtcaaaagagtagtggtctttagctgagtgcagtgctacatgcctgtaggcccagctactcaggaggctgaaatgggaagatcacttgagcccaggtgttcaaggctgcattgcacatgattatgcctgtgaatagccactgcactccaacctgggcaacatagtgagacccctgtctcttaaaaaaaaaaaacaaaaaagagagtagaggtcttaaagagctatgtagtagaagttatggagctgaaaaatgagagagggctattatgtgtcagggatgaagtaatatgtgataacagatcctactctctcactatagaagaggtaggtaaaaaagagtggaggtgaagatccttaaagcaaaggagttttgggactcagcaatctaggtttctggattggggtgggtgttgcatgtggatgatagaattttcaagtaccatggcaagtgttggcatagagaacaagtttgaaagccaaatttcaaactcttcagccaatgggcaataagtgaccagagaccggtgtttgatagtgatgacaacggatggtaaaggtcactacagataagaagtctgagaactataagatggtgtgttcagatttcatcagatgatggcaggagatgagatggagaggccaccagtgacccaaatgaatgaaggcacacgtccaaggagatggatagatgaccatgatgaggatgggtaaaagctggtatctccagatgatatcaaactaaaggaatgatgccatgagtatggagtaatagactctataagcaagggggaggcaagaggaagcttgcttattgccctctgagttacatagttaagaggttcacagggggaagaattttaagaagacagccaagtttcaaggaatgtgggtggttgtaaggtagggtttctgatgttaagatatagagagtttgattaacaaggatggcaggttctataggacgtagttttttttttttttttgagataggttcttgctctgatttccaatctagaatgcagtggcacaatcatagctcactgcaacgtcaacctcctaggctcagatgatcatcctgcctcagcctctggaataactgggattacaggcgtgagccaccacatccagctaattttttgattttttttgtagagatgaggtctcactgtgttgcccaggctggtctcgaactcctgggctcaagcagagtcctcccacctcggcttcccaaagtgctgggattataggtgtaagcccctgcacccagccatataggacatagctagtttgtttgtttgttgatgagacagggtctcactctgttgcccaagctggagtgcagtggcgtgatcttgactcactgcaatctctgcctcccagggtcaactgatcctcctgcctcaatctcccgagtagcttggactacaggcatgcacgccaccatgcccaggtaattgttttgtatttgtagagaagttttactatgttgcccaggcttgtctcgaactcctgagctcaagcaatctgcttgtctgggcctcccaaagtgttgggattacaggtgtgagccactgcgcctggcccaggacttagtttaatgaatgggagagagagagggaagggaaacaattaggtcatgtatgtggagtggaagaaggaagcccagagcagtaagtagatcaggataggcaattggatgagagtcatgggtagatgtaattggccttttgagtcccacaatttttttttttttttgtacaggcattttcagtaaatgccatgtaagcagtgcagagtgccacaggagtcactggtcagtcgcttccaccaaccgtttccttttgcagatactgcctgggtctgaacctgattaaagttctacattataggcttcctactccaaatcctaatgtttattctaactagtatcagtctgtttcagtcaaaatacaaactataacaatgaacacgctattttagaaatgtagccaaaatccttacttatgatctatgattatgtttcttttaaattttaaatgtattcctaggagtgaacgaaagcgtttcttcatagtgttttatggtcaccattagagcccaaatcctgctttccctatagcaactgggtggttgtgtttttattaatctattaatttattttaaaaaagaaaaaatagcagcaaaagtaaagtaaaccttaggagttacacaatggattgcatacttaatgctatggacaattgctaacccaaccttactttaacatttacaaagccagttttgattagctctttattcctagttatcagatatactccatttctctaaattaagtccagaggtggtccttactgagatttatagccactgataccacaaagtcttataatttagctgtttaagaattcttttgggtaaaaataatttaggaaggaaatctagtgttcaccaggttggaaacaactggacattagtaaaattgaagctccttagcaaagcttattccggtttgttatataacataccgattaatagccagaggttacctggattcatacaagaggcactgtttctcaaggtcaagcattgcatggccctttattgcaacttttcttttaaatatgaacgtataagtcagacttatttttggatgatcatagtgaaacccgaagatccataatgaagtttatgtgacagagatccccacacaacaatctgagcgatctctatagtggtgtacaacttccctgttgctttggcagtttcttaaacgtaattattcccaaagcaaatctattcaagcatatttaaaaagaatgggacagtatttggcaagcataagcgtgttttaaaagtgattccaaagatttaaaggttttagctgtaagaatgatggataatgagaattgcagaaaattagcgagagttcttttgccaagaacagtagtttgggaaagctttgggctttaaatagagggaattatgaataaagacagtagttgataaagatgaatacagtaaaaattaaagtgttgttgcctttaagagtattttatgtataaacttgattgatgtaaacttaattgttcaatgtttaaaagctctaattaatgtagtttatacttagtatgaagcacatcaaggtctccatttcctctactcactggaataattgaactatatattcagacttctctcactgcttcactccctacatatattcccctttacttttctctcaaaaatccctgacttctcctgataaaaataaattgctttaaacatttattgttaataaatgcattaatgaaaaagcagaaacatttgtggtggtttctctagttttttaaagcaaatctctgtaggggttcctaatttagttctgttccacgttgccctctggtcactaaatcaaacacagagccactgctgcttagggagctggcattctagtaaggcaagctagtgctagggcactagctggaagcctgttttgagctgactggaggctatgaaccccctaaagaaagagacagggtcccttgggcctgaggcttatcggtgatgggaggaaatgttgggtccagcccctggggaggtgaggtgcactagagaaactgagaggcaaacaagtgtgtccaccaggacctaatgttgctcacaaccccttaaccacttaatcatctgtcattcttttaagtaaatacctgcttatgctcattttatcgttttgaacattccatcttcagggtgctaacttgacaaatttttggtaaatctgtgcaatattagataaccacaggaacctttttattcaactcccacactttatgaatgggaaaacagactcagagagggggaactgagatagagttggctttctggtaagataagcttcctaatttagcatggggattatgcttatcactgtgtctagctcattccatgttctttaaatatttgtttcaataaaatgggataggcctttggattaggggatctcacaaatacacaggcccctacacacacacagattattgatttgatttggaaagaatgataggagaaggtgaatgtctgaggccaaccatttgcaattctaaatctgtggcccccttcttgttcagagctgttagctgctctgaccatcttctcctctttagttagggtgctaccagggcagtatggaaggtttcttcccactgcttgccctgcatatgtgctttcttcttactcggcaccaggcctttcctgcattgcaggtattgcagggccacgtggtatgacacagttgggtgaatttgattacacatgctgtttatttttgcttccagtctagtgcttacccagagccctccactctctgctactccttgcattcaaccctaaactgagtcatttatcataacctttgctgaaccttttgaagctgatttttctttcctttttgcaagcattttgttttattgaagtcttgaatgaagtcacaatgtactattctgtcttttgttcatatgctaattaagaagtgttatctagttagcgtggcatagttcatttacaaaactattcatggtcattttgattttataaggtttctctctgtttctgtttcgcaaagactgtatatatgttttttagttaaacaaagttaatgttaatttctttcatttgtgctccctgagtttcaagtgtaataaccctgcagatatatttcacctatttgtattagaattatatttttttccatggacatcagttttttttttttttctttgtcagaagcaactagttattggcagcaaaggaatttattattccattgtgctatataacacaactaacaattttttttcagtatttacaatatgaaggcactgtttcataattgctttataagttgtcatcaacataatcaccccctttgagactggtgggaaaactgagacatcacatggttaaggagcttgccccaggttacataactaataagtggcagaaccaatatttgaacccagatatctggctgtagaactgatacacatagccagtatgcttctgttcttcatcatcccttgtacaggctctttgaaacaacctggtaattgccatgctctatgaaaaaaggccattaaaattgcaaatattggagtacctctgatttttgagcatcaaaaatatacccatcagaagatattcatgagacagttaaacattgaggctccaaccttgtttatactatattttcatctctggtcatacataacttgatgacccttggtgatctcaaatgactctaaatgatactctgattttggggctaggcctgtttaatcaaatgagtgagccatatctgtttgtaattcttccatccatccatctttccatctgtccatctatagaattcttcatctgcacgtaacagacacttaggtgttacttatccttactgcagaagaagtcctgttgtatcctaagagaataagacacagcttcaagaatcactggctgatcaccttgaggggaagccagtttgtaagggttcgccaattttatgtatctgcagccttccatatgttacagggactcttaattaagctgctgaatttggcattagttgaactttcagtttactttcaaggagagtcatgcagacaattccagtccaagagaacagcagttgggaataaactgagatacttggcgagaaaatgaggtgggagttgaatttgatgacagcagagcattcttgctggagactactagtggaaaatgaagttagaatggcaagggaaagtaaggtttgttagagtagctctgaaaccaagcacagtatacaactgaaaataaaattctcttgtcattgtatgcagactctagctttggagcctggcacgtgtgaattatacaaagattttcaaactaatttgatcgtattctagatcacaagaggccaaaattacccaacgctcagacacattaatctcttggaaatttaagacaaactctacgcagccccagtcagcctctacatttcagcaactcttattcctttcttctgtatttacttagcagtgcgctgcaaatatacttgtatacttccttcacttatgtcctacttgtgtttcctgtcaactctatgagattgtaaacttgcctattgcaggaattgatacagccctagctcagaggtcagtgagaggtagaatgcaagcaaaaggagagaagtgattgggcttcgcctcagcctgtacctactacccagctgatacttttcacaatggcaaaaggtgaaagagtggaagaaaagggggagagttactctatggcacatggcaggaggaagattggtacccttggagggcatgtatggaatttaaaacctgctcactttgggaggctgaggtgggcagatcatgaggtcaggagatcgagaccatcctggctaacacggtgaaaccctgcctctactaaaaatacaaacaaattaggtgcgtgtggtggcgggtgcctgtagtcccagctacttgggaggctgaggcaggagaatggcgtgagcctggaaggcggagcttgcagtgagccgagattgcaccactgcactccagcctgggcgacagaaggagactgtctcaaaaaagcaaaacaaaacaaaacaaaaaaacctgctcatgcattctgggcagggcaatgcaaggcaagataagtggagccttggatagcaatgggcctgtctttgagttataacctgataaggtcctagtcccaggaaaatagctaggggaacgaggaagaaataactttccttagggaaatcacttaaaaaaatcaccttactaggttccattgtttctgagctccagagcaagatggagtgtgtatatatgtgtatgtatgtataatgttttaaaaactttattgtttattgccttttccatcccaaggtaccagaaaatttcataagtggcaatttttgtgattgaaatataccacttaggtgttctagttgttcttctacacaagattcactgtagtctcagcatggggatggcaaaagctgataggagaaaattttctctcttgtcttttgaacatcaatgaaaggagagttttccttacctctctgcagctcttgaatgttgaattttaatattctcatttggagtttcatttgaacaaatagctttcttctccaagcccttgtaccaccaatcatttcaacctgcagttctccttctctactccacctcaccctttgtagaaacaattctttggtcttagaaaggtttagacacagttcattaactagtattttgtatttataaaaattcaagtgtgtggatgaaaactactgaaacaagtcttgttgtctaattgtagtagagtatctaggtttagagttgattgcccagtagtgttgtagagactatgacccaacaaatagtgccgttgattacatgctgttatttactcatttattagtgagcactttgtgtgggcttcattactaattgttatgtcaaatatctgtataaataaataatatctgttaatcattgagatgttattctttaaaatgtaattttcagtttgtaaaaagtgcaaagataatgttatatcacaccagtgtcctttgacggctttggcagagtctttaaaaaaattttttttatttccatagatttttggggaacaagtggtatttggttacatgagtaagttctttagtgtgatttgtgagattttggtgcacccatcacccgagcagtatacactgaacccaatttgtagtcttttatccctcacccccttcccacccttcagtcttttttttttgtatgagactttatataggttagtgatatttctccctgctctgcttgcagagaaatcaatgctgtgaaaaataccctgccccagtttatgattattaagtgagataaacttaaaaagagaacagctcatgactggctgatttgaatgtttgtcttatgcccagcctctgttccatggtacacactagtgccagatgataggcccttctgaaaaccttttacaattgtccttgtattttatggcaggatatgttcacagaaaattttctgtaagtcaaaataatgtaaattgaatctgattttcttcacagaaacaatattacattggggattatatctctggcctaaagcctgactttttataaaaatagaaatagctgtaaccatcattttaatcaactgtttaatcagctggaaatgatgaatctgaatactgttcaggagaaaattgtctgaagtatgtttaaaatcagttaacaaggcatcacaacaaccagtcacattaaattatgtttaatgaactaaagtgtcgtagtagactatacaaagtttttgtcataatcactgccttgtttttactgaaactaattagaaggtggtttttcttaaagcagtttctgcaaagtcaaggacttctcacaggatttcttttagtaaattttgataggtatgcttgaggagacttttgggggagactttgaagagacttggtgtttcggctttttgagaaactgaattgagattttcttcatgctttgctttgctcattgtaaattccctgtagcagacatagattttggagaacaaattgttggtctgtcttcattttgattgtcaccagagaagggttaatgataaaattatggttgttgagatctgaaggattattatcagcaggtaaagagggaagagtattctatgccgagggaaacagtggaatactcagggacaagaagggtcctccggcttacctggaatggaaaaaaggccaatgggttataatagagaaagagaagaggagggcaaatgaagttgaggaaataggaggaagagaccagactgtgtataaaactttgcaggtcagaataaggattttaattttcagttctaagatcaatgggaaacgattcaagtggggcctggaggagcaatatggttaggtttgtgttgcacatggttgttgtgtggtcctagctaggttagccctcagggtactgtgcagccatcattcttggcacttagctgagttgtatgagcatttgatgaatgcccggtctcccctctccctatactctaagctccttgaaggcaaggactatgtcttttttactcatcaccctgtctctagtgctgtacacatagtaggagctcaataaatattggttgaatggatgcatcaactgtgttaacggatttaccttgtgacccactattaggcaagggagttacttttttattgaggtgaaattcacataacataaaactaaccattgtaaagtgaacaatctattggaatttagtacatttatattttttataaccacaaactcgtacctagttccggaacatttttatctccttaaaaggaaactccatacttattaaacagttactctgcattctcccctccccctagcacctggtaactaccaatctgctttctgtttttatggattaacctattctgcatatttcatatgatggaattatgcattatgtgaccttttgtgtctggcttctttcacttggcataatgtttttgagattcattcacattgtggaacatatcaatgcttcattcatttttatggctgaataatatttcattgtatggatataccacattgtgtttatccattcatcagttatggacatttgggttgtttccaccttttttttttttgagacagaatcttgctctgttgccctggctggagtgcagtggtgtgatctcagctcaatgtaatctctgcctcctgggttcaagcgattttcctgcctcagcctcccaagtagctgggattacaggcatctgccaccacgcctggataatttttgtatttttagtagagacagggtttcaccatgttggccatgctggctcgaactactgacctcaggtgatccgcccaccttggcctcccaaagtaccgtgattacaggcatgagccactgcaccagactgtttccaccttttgaatagttctgctatgatcatgcatgcacaagtttttgttctgatacctgttttcaattcttttgggcctatgcttaggagtggaattgtggggtcatatggtaattctatgtttaactttttaatgaactgccaaactgtttctcataggagctgaatcattttacagtcccaccagcaatgtatgagggttccaattactccacatccttgtcaacacttgttattttctttttttttttcttacaggctgttcattcacgccatctggaatgcatgaatgaacttccccttatttgcagtgaatatttcattccttggtactttattacatggttatttcacagtatgaaaatagaagtaaaactcaaaggtatattggacagaattggattctaaattcataaaatttgagtccaacagcattctggtacattgctttctgagatagacctgcaactattaggagaaccccagtttttctcttatatactatttttaggattgaagaagcagtctaaaggactaatctcacatccaaagaagtttcttccttctgaacatatgtattggttaaatcatttaacaactcttctattggaggtgtcttttgagagttgcattgagaattatgaggaagccccatgtagtcttatagctgaacgttctcatcataggcaattttctattggtttgacacatttgtatttctacccttctcctttttgtttttgttttgttttagtttagctgtgctcagcatgcagggaatagttgtatttgcttatagtaaatgactgggaaccaagctgagatgtcagcagaacattgtagaatactcaagtacactgactatataaagatcattcagattcctgtccatctgaagtaatcagactatcagtccaccattaatttgaggtctatcagtcctcattaataatgctaccaatgcaaatgcactttaattccattctttgaggactgcctatatttcattgggttctgccatttttcttcccttaagtaatgctataactattttctatttgacagcatgtagaacattttacatcatatccgagtttacaaagtagagtaagaatagacttagaattgtattaacatgttgcatacacatgtgctttttataataatgcaaactggagtgaaatgcattgcagtcaggagaattgagtctttatgaacttttaatttttgagtactagtcataactaagctgcttgcattccactgagcaaaggtttcctaatgaagaaacctacaactactgtgttgtttcatgatttagctgaaagtattattttctgtttaaagcttcctaggcattttttaatgttggctgtaaattcttataatggttctagataccccctatgtgtgctttagaaataccccattgctattttcagtcatacacttgaatagaacttctaactactgtttgtcttatttggtaaaaaacatttgttttgtggaaaattgtttggtttgagggtggtttggcctttagtgtgagtggtgtttttgtgaagtcatgcgttttgaatgtatccactctaataaaaattatttcaaatggctttatctctcctccctgtccctgtgtgtgtgtgtgtgtatgtgtgtgtgtgttttcattttacagcagaaatcctgtgtataggtaagatttgtattctaagaggtttattaattttaaaaattgccctcatggtagttaattctaacctgatttacttgcagttgtttgtaccttggttgctgggaaatggatttcattctgttttatcagaggagtaaacaatttccctagggtaataggcacatttgagaaggcattcattttttcacatttaaagattaccattaagtaaattgctactgtggtgctttaagtgggcatcttaaaagcctgaaagaaccaatgtaccctctagtgtaccaaaattagcaccttgaaggagttttatctagtcagtttgtacttaaacattttttttaaaggcattagcacatgaacctttccctggactttgtgacttttcatgaggttttatttatttttccctccttttctgctttgaagcctgaaattgtttttgtttgtttttgttttggagagagtctcgttctgtcacccaggctggagtgcaatggtgcgatctcggctcactgcaacctccggctcccaggctcaagcgattctcctgcctcatcctcctgagtagctgggattacaggcacctgtgaccactcctggctaatttttgtatttttagtagaggcaggttttgccatgttggccaatctggtctcgaactcctgacctcaggtgatctgcccacctcggcctcccaaagtgctgagattacaggcatgagccaccgtgcccggcccaaacctgcaattttttattccacatatattgtcttctcgtgtgtattagtttgtaagttactctttatcctgaaacagggagtaatttcttcctcacccttgaatgctttttttttgttttaggggactaggctgaaacaggtggcaagtgatgcaacatccaaagccacttttcaagctttttttttttttttttttttttttttgagatggagtctcgctctgtcacccaggctggaatgcagtgatgcgatctcagctcactgcaacctccgcctcccgggttcaagtgattctcctgcctcagcctcccaagtagttggaattacaggtgtgtaccaccacgcctggctaatttttgtgtttttagtagagacggagttttgccatgttggccaggctagtctcaaactcctgaccaagtgatccacccacctcggcttcccaaagtgctaggattataggtgtgagccaccacactcggccggccacatttcaagttttattgctagaaagtccgtccccactagctgggtgcggtggctcacggctgtaatcccagcactttgggaggccgaggcgggtggatcacctgaggtcaggagttcgagaccagcctggccaacatggcgaaaacccgtctttactaaaaatacaaaaattagctgggtgtggtagtgggcgcctgtaatcccagctattcaggaggctgaggcaggagaactgcttgaacccaggaggcggaggttgcagtgagccgagatcacaccattgcagtccagcctgggtgacaagagcgaaactccgtgtcaaagaaaatctggccccactttcccctgcttcattttagatcagattatttagtcaagtcctctccaagttacatatgaagaaaccaatgccaggacttccccaagacacatacagaccgattgatggtagaaggctattaggaccttgatctcctggtttcttgcctctctttattaagctttagaagcaaaaacacccacctgggatcatagccaaatacttaattttatcaatttttggcatacatggatagaaattgtcacaaatacaacactgatctcacctcataaccttgagtgctttgccagtatagctgattgtgaataccatgtgttttttctaccagtggactctagcatagatgtagcccagatatgtagacatgtttgctgagataagaggtatattacagtagcattgcccaaaacatgttgtacagaatgtgatgtcactggattttccttgtgggaagaaaagagttctgtggtcaaaaaattttgggaaatgctgacttacacaaagttaaaagaggtttcttcaagactttatggagcttttactacatgggtatgcattgtgaataaccaggaggaggggtgggcttcccctttctctaaggaacctcattattaacttgttccatgtaattcagtctggggaacattgagtgtggtgtcctgatattcttgccatttatcttactgtggcattcctagttggcagtactcaaaggcacattaaaatttaacaatctaaacaatttttatttatatgtaaggcattactgaatatttgtcgtgctcttctttttatgcttcaatatccaagttatacattacatttcaaacgtcttgctaatttatatagtctcttttaagcatgttttaggaataattacaatcagatcatcagttatatttatagcagcatccagtctttatagtgcacagaagcttcaaatccaaagctttggggagagggaagagatgatggagagacagtgtcaataattccagtgcagttcccaagtgcctgtgtactctgccacaaagggagaaacgaattcctatttttactgtcaggatgtcagatcaacagttccaaaatactaacggtatatgttctggacagcagcctccataagctcctccagtggccctcagttgtcatcaaacatggcacttgtcaagctccctggctaactctagtcctcttcatgaacactgaagaacagtgttttcaaaaccaagcactctctgctagtggaccataattcatcctgcccctttaggcaggggtagcaccaaaatttcccgtgcctcttctgtagagccagaaactttcttgctttaaataaaacatttacatgtgggttatgttgaggacgttgcctagttccatgctggcccagttgctagagtttcaatattcctatagtttgttaacatctgcaaacctcatcctttgttcctgcgaatagtttacagtcatttaaagtgatttctgggtgtttctgttaatcctgctgtaagcagtctcttacgttatgtgaccttattttatagataaggaaatgaggctcaactaagccattttctccaggtctcattttgaagaaaaaaaaaatgtaaataatatttctcagagtcataactgtcttgctttccctgtcctctccagattttgccctgaaagccttccctgtaggaagaatgtttgtttttttttaaagagatggggtctttactctgttgcccaagctggagtgcagtggtgatcatagttcactgtaacctcgaacttctgggcttaagtggtcctcctgcctcaggttccctagtaggtaggactacaggtgtgtgccagcatgccccgctaattaaaaaaaatttttttttcgtagagacaggggtctcactatgtttgaccaggctggtctggaactctgggcctcaagcaaagcattgggattacaggtccaagccactgtgccaggtccaggaagaatgcgccccccgccccgaaaccctttactttcttcatttattcaactaagccatgctccacaatggaaacttgctttttatctacctcttttgttggggatgttaagaaaagttatagcctggatgtgctctttaaattaattacatttacagctcgggcagtttttaagccagtttgctttttgtatggtatttaacagtttacttggaaaaatgcattcattggttttgctggacacactccaacttgtatttgaactggcagacctttctaggaaacatcacttttatagtaatgacactatcactgaaaaaagaaataaaaccctgttcaggtcgtcagacaccagttttacaatattttttcttttgctccagctagagtttcttatctcttcttaaactgtaataaaaattcttctgtggtgatctagaaagtaatttttggatgagaatttatctcttctaggtaatgatgctggtcaaggcatttttctccctaatatccactggcttttttccttgcgattgctagatattactgttggctgctgagatataactttcttacctctgagatatctaaatagtgagaaaagtcttccatccctaagggacctttccacataaaccatctgcttaggcctttgttgcatatatttttgaagcttgaatttactgtattacagtgactcttagggtggagaaactgtatcatagtgaatacttagattatgtctcttcctcttaaactacaactaaaagttcaattcaactttcctccgaagcttattgtttagccccactttttattgtggtccatttattgtaggcagggattagaaaagaacttcccaagatgaggaaaaattactgtgtggtgtaagatactgatatttaaaataataacaccttaaaatacagaagttacaaaggcaaatcaggtctttggagaagaataacaaaaagatatgaaatggtgcaataatggggctaaggccgccagagtactgctttgagctcttaaggaatagactgtcatctgatgcttcctttgctgcctcccatggaagtacaggaactaggcaagccataattggctcacttcccaagttctgggaaactttacaaggatcacaggggttggtacaagttgcttgataatctgcagcattctctctgagatttagctgccattgtgttgccaaatttctgcatgtcagtatgcagatggtcccatctctccctccagcctctgaggtttgtaatctatatttatttctcctcttttcagccaggttgggttttgaggtcttggggcctgctttattcctgctttttatttgcatgtatatttttatccatttcctgagggtaatcgtaaatggttagctggattttcagcctcactgctcctatctttaagagttaagaatctccttatttagagttttaaattttgttaagtgtttggaatgaaaggctgtgtgtagagatgggtagggtgaaagtgaaagggaacttctgaggttttgtatacttgctggttaagtttctgtgcatattgtcaggctttgggttaggaaagattctgttaataagggaagttgagttgctgagaccccaaaggaacactgagagtcgcaggttacttcctataaatggaagaacctgaatcattaaaagataaaattcctgttagaatcttgaatcacagaatgtttacagtatttttgatccatcaactttctattagcaatcctttaatgaagctgcatttcagtctttagagccacaatttctgagccctgaagttcttggagtaagggcatggtgggggaagggggatcagattgggaatacttagaattgattgtccctggtgaaattaaactgctcagtggatcactttgagataatgaaaggtccactctgagcttccaaacaaggcattgttcttatccaaatcctcatggtcagtctttttcttaagtgttgtgcttgctgatttaggtgtttgtgtgaggcttaatatccatttcctgtagtagtttttttttttcaattaaatgtgaagccattgggtaatgcctaattagagaaatctttgtgtttagggataaactttatgtattcatttgtcctttggtcaggtgtttgagaatttcagttaatatgactgtaattaagctttaaaggcagaacaacacaaaatgccccatcagtcttgcttcacttcctttggcaaaaggagagacagcttaatcacttcagaagttgcagtaaaagcaaaatctgaaaagtgcaattttaaggatcattttagagttatgattgtaaattacacattaagtttattcatttttgcttgttataatggagtgggcttggaaacctcagcaatttgaccaccgaatacattgtagttattttaaccaagaagcttaatacactggaaatgtttcctggcactgtagtgatctcctccccatacccccaccccttcagccctagtatggaaatgctgacttctgggagcattttagtagacatctgaaattttgatgaaatgctctttcaattttgaatttggcctttttaagacactatgctgttcaaaaatattcctgcttcagagaagaaaatagctttgggctggagagtggagaaccattttaaatcattgccaagtcttcagattttaataagaaatttttttgttcatttttgagcaaatacttttatttgctgtggttgcttacagaaagcagttcgatgaccaataaaagtaatgctgtaactgccagggattacgtcggttttaagattatttgctgataatccaagtagctttgcattatatcagggcctgtaattctcattatcagtgatctgaataattgatgggagataaccacatgcaaaataaattgtcgaaggggaatcttactttgcgagcagcttaaaatggttggacggaacactgagggttatttgtatttttaacctttggaaagcaaattgtttaaattatttaaagaaatagtgcaagattatggctggcatactaaaaacttgcaggatgttatttaaggacgatcactgtttgaaagagtctgtggcagtaattcttagctgtgcttgcaaattagaattgtcacctggggagcttccagaaaaattaaatattaaataaaagaaccaggcatcagtattgtgtttaaatccactgtgtgaccaggattaagagtcaaagatctatggctaactcataaatataagtttgccagcaaatggaaaggatatagaggtaggctttatttcagatccttttgccagcttttatagtaacagtcttgtattgaggtctctgtttttcttcagttcttatctagtcaggtctggaggcaaccaaggaacaaattttatttccaatggcttttcatttttttatgactagcaaagacataggattttaagatggtgccagttaaataattactgtgttaggttttttattgagaggccattttggggtataaattacttgctttatttttttttacagcattcagtttatactatggaggtataaattaggagtacaaaaggttgatttttatcttgagaaagaaatttacattgctttctctgttaattcatatattgtaaacatattttttaatatttgccatactttattatgtagtgtgatgtgtcattaaaatagagtcagtaccagcatatttccagttttaagaaatgctgttcttaaggacaattgaatgggaagcagttcagcacaggatggactcctaatgaattacaattcattacgaggtgccaggaatcacacactcccactccagactacactgcgtgccatccaaatgggaattttaaaaatgatttctacttagcgtttctctgctttggcaaagacacctacattattcaaaatcacaggaactaacaccactgtttttaacactctatattggcagcaggtgggcaattacattgaatttacttgagttcagcattgctattttttatgtgaaccaaatattattatacagttgcaggaaattccaccagccattgcagtttcatcagcttttagggtgaaacaggcacggaaaagacacctacttcatactaccccacccccagtctcaggcacgtctcaacccaaacctgtttagggtaaagagactgtaaaatgctattttggaaaatgctcaggagtggacattctgctgcttctttcaggcttctgtttcatcatctaacagcaatcactgccgggatgtgcacacacaaaaccccaaacctgcatagtaatttcaatccattttctccaatttaatggagatagaggccacttaggccttattcagaaaagatcagagagatagtgtatgaggaaagctcttagtgaaactggaaatgtcattcaaatgtagggaattaataaaaatatcagtgtgcctaaaaaaattgtattgtgctttttccttttgttctttggcatggaatgtagaagacaattcagaattgggaaagcactagtccatttctgttttaagttaatcagtggttgctgtaattgaggggaaaaatctatattgacagcacatgacatatcctacttcactgattctctacctcctttgcctcttccccctttccacttgtagaattaactaagaacttgtataaaaggtaaccctgcctcatttactctgcagccacttcttccttgtgtgaaaaactaaacagccatatgaatattaaattaaaggttgcaaattgcaatgtatacgtggacttggcattttctgtaattcaaattggtacattataagagtcaggtctgttgtggagaccacagagaggccttaacctgcaacagaaggtgggagctggggtgaagccagataaactatacatctggcaggtgcacacactttcacttttaagttttacaaaatggatattatggaaaatttggtgctcttatcagtaagctgtgtcagaacctgtatattacagttgcaaacagagaagtaagcccctaaatcaaagctaccacttggtaaaggtactgtttactggtttccaggaactgtgtgaaaatttatctatgaatcatttactcttagcatgcgaaggaccttggacaatcagttgttctaatgccttgtctttgggcaggcagataaataactaagctatccagcatagatacttaactgactttttccaggtctccagggatcccacaaattctcttagcacatgccagagtagctttccagagttatatacagcctgaatctcttctacttcagtttgtcccagttactttttgcatgattccctacaaattttgaaggcaatatcataagcttaaatgaaaacgcaaggcaaagaggttttatctgtacttggggggtgatttttaatttttaaacgaagaaataattttccacataccatctacataagatgcacaaattcagactggagtactttcagacattgtagataattggaagactacaagttctaagtagtcttgcttaaaatgattactttgagggtgggatttatacctttgacctttaaatagatcactgaaaggaaggaaaatctttgtgactacatatattaaaacattttaggttggggaattatagttctaaaaaataatgggaatatataaatgggtatttgtttctgtcatgcatcctttgacttatatatgtggtagtctcagatatggtaatatagtaccatacaaggagactgtcccaaatttatataagaaaagggtattatcctgattaaagtgaagagagtgaggccttagcaaaattaaagggtgggataaaatagagcccaatcttgaaacttttaggttcggtgagtctacttattaaaaatgtaaaaggggcatgagaaatatattgtgtgaattggaactttacaacaatgaggctctgagagattgcaaaataaactatcctgtaaagccaaataactagtttctttttagaaaaagtcgatcatttcttcaatagaggcagccattctatttctgacctttacacttatacacaattattttgtgtttagaagtaatctgcattatgctttctgttctctagtaaggtagttgaaaggttgtcctcagtagttgcataataaatgaaatattcccagtccattctttcgtgagttagtgtgttgctagtgaaggttatggttaagattcatttgggctgtggatgaaagaaaaatgattggcagtaaaaatattgtttctctagggtactttctttaatcattttagaattgcactgttgacctcagaacagttggttcaaacagcacttttactaatctttactatgtcagcaagtaagagcttaatggattttgaattccctaacaaggttttctcctctccctactactttctcgccagattatggcccagcatgcttggacaagaattatgggcttggtagaagtgtggacaaatgtgatgaaaaactgaattttttcccttttctcttggtcagtgtgctggagaagagaaacgagttggcacacgcacagtgtttgttggcaatcatccagtttcggaaacagaagcttacattgcacaaagattttgtgataatagaatagtctcatctaaggtaagtttttgttttaactcaatagatgttcatatagtgaatcagataatgcattctaatttgtgcttctgaggaaactgatgcatttatgtatgtgtacatgtatttgcatgtatatggatcatataccagctataataagtattcctctgaaagacagtttatttaaaaaatcactttgtcttgttataggtgaaagatcattcacttgccttccgttatgattcacagtgcttgttgattatgcatattactttaaaccgtaaagtttgctaaaaatacaaattacttacttgtgcaaagcttcctgaattacccttgaatggatgaactaggatataaaagaatgcaaattcttttataaaagaatttgcattcttttggagaatgctgtcctggaatgactttatttgcatttctttctagttcccctgccaacccctccacctcccatcccacttctcaagtattaatagactcctacgtcccaaagggtgcatgctgctcagtacactgcttcagctgtgatctgttaagagttaagtcactgcagctgtgtcaccgtttgactgcatctttcttcagcatagtgtaggactaagagcattggcctggaagtttgaacacctgtatttaaatcctggcccaaccacttactagttgtgtcaccttggtcaaattaatcgccccgattctaaatgtcctcgttggtgaaatggggctaatactctgtgaaaccacttcttatagctcctagtactcagtagtcatcattctgcaagtgttatttagctagtctttacctctggctgaccaggttaggtgctaggttggcctactgccatctcttatagaatggaatagatcttgaagattttcctcacttcctcatgtgccctggcaaggcagagataaaagttggtgacatttggttcactgtacacttgtaatcacttagaaactgaaacacaaaattatgcccttccttaaaaatatatgacattttggttttcaaatatgcatttaatttcttgtttgggcggtgatacagtagtgatcatgttttgctgggagattaacatgtgaaatatggtcaggacaggtgaaaattttgttgcctaatgagcagatatgtaggcctatagaacattttattttggataaaaatgtctatttcctcttaatcttacacactagtggcagaaattttattctcagccagaggttgacatacttatgcctaaaatagtgaatagttcttttactggaaatttcagctcaccttgtggtatccaattaaatggtctgtagtagtcctttgattcagaattgtggacttgtagagctaaatggtcttaagaggttaaggccagagaaatttaggcacatggtcaccaagcagagttagtaataaaaccaggagtagaactactttataaggtctagttgctctgaataaagaggtctttttacatcatcgtgctgtttgggttccttcctcattttttttctctcctcttgcattgtgcttggcatggggcgacaactcaaacggtagctgctattgttatttgtgtttctgtgattattattacaatagtgagtagtactattgatttcctcaagttcatgtgttttgaatgtgtgggatactgtctcctaaatggaggccttcaggtctactccgaaaagaccaacaatttcataatttgactttttcttcctcacattgtcttggctgtttgtatttataccagaattttttaaaggattattttttcaaaatatactgtttatagaatatgttagctgccttccaactttgtagcaagtgttgattttctttctccacccttcagtcataaaaataactatcttaattggatgccgcttttgtttacaaataccaccagtaatgtgacattataaatgttaaggcagggaacactgaagacaaacattttgacctactttaagttttatttgcttataaaagtaatgctttttttgtgggggggagacagagtctcgctctgtcgtccaggctggagttcagtggcgcgatcttggctcactgcaagccccgcctcctgggttcacgccattctcctgcctcagcctcccaagtagctgggactacaggcgcccaccaccacgcccggctaattttttgtatttttagtagagatggggtttcactgggttagccaggatggtctcgtgatccgcctgccttggccttccaaagtgctgggattacaggcgtgaaccactgcacccggcctaatgctttttgtttttttatctcctgggaacacaaatactttctttagaaaaatttggcctctacagcctcacaaactttaatgtactctgcagggattttggaaatcaccagaattttgtagctggtgcaaaacttggaaattcccttctttagcaaaaggagcattgattgtactctgctatgaattttaggatctttagtttccatcatgtttatctgttgtgtgtttttttcctttaaaaattttaaaggttttttttaaaaaattaattaatttttttttttttttttttggtatttttagtagagacggggtttcaccatattggccaggctggtcacaaactcctggcctcaagtaatccccctgcctcagcctccgaaagtgccgggattacagaagtgagtcactgcaccccgccctttgcccagcttttaatggagttgattttttttcttactgtttgagttccttatagattctggatattagtcttttgccagaatcataatttgtaaatattttctgccattctatagattgtctgtttactctgttgattatttctttcgctgtgcagctttttaatttaagtcccgtttgtttatttttggttttcgggcatttgcttttttgtcttcgtcatcagttatttgcctaggctaatgtccagaagagtttttcctaagttttctttgagcagttgactgctaactttattattactttaaatatctactactttatttttacctttttctctttcttttttgctgctattcagacacattaaaagttattcagacacattaaaagttatttggagtctcaagttcctcatctgcatttttaatgctaaaccatcagcatttttaatgataaattggaaatcttgggtaacacagaactggtcaaaacaagtaaagttctaaagcctccttttgcttaaatgaaataattgactctcaaagctgagattctcttcaactttcctcctttgggaaatttgcttagtaagtttataaagttttggtttcaaattaaattagatgatacatatttgaggcagtgacccacaactttttcacataatttcatctttagtggccacacttgtgtacagattatttaatccactacaaagcatatataaaatgcattgtatgtaccgggaaagctggcgttttttgtttgtttgtttgtttttgagacaagagtctctgtcgcccaggctggaatgtagtggcgcgcgatttcagctcaatgcaacctccgcctcatgggttcaagcgattctcctgcctcagcctcccaagtagctgggattacaggcgcccgcctggctaattttttgtgtttttaatagacacggggtttcgccatgttggccaggctggtctcgaactccggactgcaggtgatccacccacctcagcctcccaaagtgctgggattacaggtgtgagccatcatgcccagcccaaagctggcattttctgtataaatagttttaaacatgttctaaatgtctgggctgctttttaagtttatagttgtacttaaagatagtataaaagaggcccggtgcagtggctcacacctgtaatgccagcacttcgggaggctgaggcgggtgaagttcgagaccagcctcggagatggttcaaagggagaccccgtatctacaaaaaatacaaaaattggccaggcgcggtggctcacgcctgtaatcccagcactttgggaggccgaggcgggcagattgcctgagtttaggagtttaagaccagcctgaccaacatggtgaaaccccgtctctactaaaaatataaaaattagccgggtgtgttggcgtatgcctgtaattccagctactcgggacgctgaggcaggagaatcgcttgaacctgggaggcggaggttgcagtgagctgagatcacaccactgcactctagcttgggtgacagagtgagactctgtctcaaaaaaaacaaacaaacaaacaaacaaacaaaaaaaacccaaaaaacaaaaaccacacacaacaaaaattagccaggtgtggtggtgtgtgcctgtagtcccagctactcaggaggctgaggcgggcggattgcttgagcctgggaggcagaggctgcagtgagctgggaacgcgctaccgcactccagcctgggtgacagtgtgagactctgtttcaataaataaataaatactatttactgacgtctccaagcaagaactaacttgtaacaaaaactgaattctcatcattgtgtctaaaaaactgctatacacattttcttcttgtgattaacttttttttttgccatagaggtcatgcttgagataacattgtttttgatttgtagcaactgaccaagctggagaatctactttttagataaacaagttaatttgaataacttgatgtatatggctgtaactcaatttcacttttagttagaaaactctaaaaagtagacttttcttggtctgcattaaaatcttacatttgtattatactaaaaaagatgtgctagaaactaagtttaccttttagttaaaccagtagagtaaatggctagggcacaagttttaataaagatttcttgtatatcttctgtgtgctaaactattgttctaggcacctgtgataaggggacttaggacatgctccatgatctcttaagagctcatgacttgatgaaggagagaagagggcagtcatttcctatgaagggaataatcagaattcctccaggaagcagttcatttaataaaacagtggtcaactaacagttgggacttaaaaacgacaacagcaaaagtattcccttttgatgtgtttatatcacctttcacagatgactctgtaatgcttatttgattaattaaaaactctttaatttgggaacagaagggtaacgtaccagaagctcagccattagcctgttgttggagtttagcttattgttttagaaagttgattttaaataattgggacagttaaaaatgctggtctgaactatgtcagcttcaaagtgactggatcagtggttttgagtggcttctatttttggtcacaagctaccttgggaatctcataagaagtgtggaccttcttctcccaagtgatgcacatccatgcacaattctgcatttattttaaaattatcttccctaaggaacttcttggactccagggtagaacctattctaagttggttattggttgtaatgcagctgttctactgaatgtacttgcctccttttgtgttttttccctgaggattccctaaattttgagcccataagcctttttaaactgaaaggttagtaaattcccatatagtatgtcgtgctctacaacttggcttttcagtcacctcttattaaaggttatgttctcacatattatacagataattgggatgggctttggtaattggtaattggtaaaagtttcatgctaaatcgcacatggtcagaagacgagaactcttaggccaactgtcaaccgcagaactctcaaatgtaaatttagctttttaggttaagaaacatttctttctttctagtttctggtcttactaggtcatctgaaaaattcaatgatttttggtcacttttaagtgattcagtccctgagcttaaggtatcagggacaaagtacgattgacagttggcctaagagttctgcagttgacagttggcctaagagttctggccgtgtgcaattcagcatgaaacttttacctattaccaattaccaaagcgcagcccagagtggtatgttattgattaaaatgaaagccctccatggcccagggttgtgtatacaccttcccagctgtcatggaaattggaggtactcatagggacagagtgactcataggggtatctgttatgatcatcaagactccagaggttagctgagccagaaattaatgtgttcattcattcctccaaataatttatttatttatttattttattatttatttatttttgaggcaggtctcactttgtcgcccaggctggagtgcagtggcaccatatcagctcactgcagcctccgcctcctgggttcaagcgattctcgtgtcttagcctctcaagtagctgggactacaggcgtgcaccaccatgtccagctaagttttgtatttttagtagagatggggtttcaccatgttgcccaggccttttttttttttggcgacggagtctcattctcgctctgttgtctaggctggagtgcagtagtgagatcttggctgactgcaaccgctgcctcccaggtttaagcgattctcctgtctcagccgcccgagtagctgggattacagtgtgcgtcaccacacccggctaatttttgttatttttagtagagacagggttttgccatgttggccaggctggtctcaaactcctgacttcaggtgatctgcctgccttggcctcccagagtgctgggattacaggtgtgaaccactgtgcctggccatccaaataatttattgtctgccttgtaccaggcactgtgttgagtgttgggaaaattgtaaacaatacaggtgaacaacctgctcctatagaactctttgcttatcaagggagaaactttaatttaaaatgtacacatatataactcactataataagtgttatcaagtaagtatatatagggtgacatgagaacacataacaaggaacctaatttagattgggtcagagaaagcaaaggtatgagactagatggttattgtaatgcgtagaatgaaagcttcatttctgaaaaaggttttcatatacagtgcctctaaatatatgcttatgtatatgtgtgagatttcagtttcaaagtgttggacatactaaatatcactttatatgataatgtggacccataatcagtcattactattaagatttttcaagttttcttcataacagtgttcttttttcttcctcccttacagtatacactttggaattttctcccaaagaatctgtttgaacagtttagaagaattgcaaatttttattttctcataatcttccttgtacaggtaagagctccttaaacagccacttaacttttagaaacttgattgctttaaacgaattttcaatctatttctaaccttaaaatgccatgtaattaaaaaaagacattccagagcttattatgacttcttaaagtagaaacataacatttaaagattatcattttgtaaatttctaaagttgtgtttttactagaaaacctgttgagattttgtttcattgttactttctttgaaattttcatggatatcatatttttgctcatcccaggatgacgtgtattgtgtaccattaaatgaaatggaatatatcaaaactgaaaatagttcaaactagtagttttattttgttacataccagtttcagcctaattggaaacttctcactcatcttcctgattaccatttttgctctctctcattcatttactcactgtaagggtgagagcctagttagatcaatctgcttctctgtattctttctactgttttgtgttttaaattttagacagtttaaattgtgtcttccatctttaaatctgtaagctattaaaatcttttcctcgccataattacccctgaaaattttactacattaaaggtactttttttctcatttcattttttaaatgaagcagaaaaatcccattgaagttgctccaatgccctgttgatgttaagtgcttctgttgactcactttgaggctttgagtaaatggtactgtaattgaatttagccttgctacttaaaatcagtctgggatataatatgggcaagagcctattttaatcctgaatgatggaagatttgaaaaggagctcctctggatctatggtcagatgtcttacagatatagaataaactacctagaggattctgcttgaaagaatcattctacttggtgggcagtgcatttcatttcagttcagcaaatgtataccactcacctacctactatgtgctgtgcagtaggacagacaacaaaaatggtagcaggtacaatgaagatcaagatatggcttttctactcttaaagaatttatgctatagctgagaagaccagtcacataacagttatgtattcacttaatgtagtaaagccattcaagaagcattaacagaatgctttgggtatacagtgtaagttatcatttttttctacccaagaggaatttgataaggcttcagagaatagatgctatctgaacagagcctttaaggattagaaggatttacttggtggagaatgctgaactggtatttcagggatagggaagagattgcctaaagtcacagagccatgtagaagccttgcgtacatggaagtatacattgtatctacaacacagggtgtatggcagaggcagggcttgttgagggttggagatgagagtcaacgagttgggagggcagactgaactcaaaatcatcctcccttaaatgtagttctttttcagtatttcctgtgtcagtaaatgatgacaacattcacctagacatgctaacccgatacttggaagacatctttaatattagcatttacatctaactcttggcatttttgcctcctaaatatttatagaacttctttccatgcctgccgctaacactagtccaagcccatcatctttcacctagattacagcaatagcctcctaaatagactccctgccttcactcttgttcccttctaattcatcttccacagagcagtaagaatgatcttttcaaaatgcagttctgttcatgtgacctttccttgcttaaaactttcaaggatttcctgctatttgtgggatagagaatgaacagcttactttggcctagagggccctgcacagtctggctcctgcctccctctccagccccatctcacaccacactccctctcgccactggcttcctttatttcctagagacctgcatatactgttcactgtgcctagaaaactacctttcgtctagttaactcctgtttacccttcagacctcagcatctacacacttgttttactgtctgatttttcctgtaagctgccagctacatgaaggcagggacttgtctccatcttgtttaaagcagtatctctagagctttgctgataatagcacaagcgctgacagaatggtgctcagcaaataggtggtaagtgaatggatatatttcaataaaggggttaatccaagctgggataaaaactatgcctgaatttaggactatttcttaaactaactgccatgtagtttgcttttgttttaatgaaaattaatatttaccctactactggaaagtgttttgtctatgtttctgtttgaaatgtttgcagcatgtaagtgctgcatatgagttaatgacaaattttcattttactttcaatttaattttatttacctaggtcacagtagacacaccaactagcccagttaccagtggacttccacttttctttgttataactgttacagccatcaagcaggtaaatttcttatttacacttgcacctgcatttcagtccaggcttgttggaatttcattgtcaaaggctctttttcatatttatatacagtgggtagtatcctttatggatttattttatatttggttcctcttgaaaacctattaaaatgataggcacatccttaatgtatttccttgtttcctcttaaatatctgtgtatgtgggtgtaaatgtaaaagaaagagcaggtaaaaggtacagcccagtcaggaaataggaggcagattttttaatgcatattaattgtttcagcgtggtatgtctgtgtgaaaaactcccatttttgtggatttttaaaaattgcttaagcctgtagcgagaactcaagggaagaatactttaattttcttgttttttccttctactgcttcagggggtagtaggtagaggggacatttcctgttttttgtcagagctgatagactgccacagattgtgatatggatgtctttgaagtattttgaacattttgtatgctagtatgtttgaaaaattgcagatgaaaatggaaacaggaaattggaggtgaaagggtaggttaacaatgttaatcatgttttgtgtcagtccacagcatctgactatttacaaacatatttttagatgatatttaacaaagtgcttttaaaaagggtaccaaagaagcttgcaaaacaaaggtcttcttagcattattgggaacaagattacctttcctcttggggttatctggtcttatatcttgcctaccaggaactataagaatattttatcaagtgttcagttgcaaaataaagacttttggaatgttcttttccttagactgataggattattttctttaacatcataaaattgctggttccaagaatagcatgtgtggttttcaaaggcttttttactgattcattctgctcccaatactggttcatgttaggacctttatttcttcaccagcatcacaaaatgtactctataaagtgatagcttagcattgtcataaagaggacagaagaagaatggatatagtacctgaggggaaaaagtggggggaggcgatgaagagacttttcaaacagttgtgtttgaaaaggtacagacattcttacaacgaaaaaagacaaaggtatataaaaaaggagaggaggtcatgatcaaacattcatgaacatcctttagatcttttggcttaaatctactttagatgaaaagtccaaagtaaaatgagccattagatctttctctgattacttttaactggaaacgatgaataccaatttatattttcttttgtcaccaagtcagttgaaaagtttagctgttgatctctacaacttatcatagcttctctgccaaaacaatccttgcttgccttttctattattctctgtgggtgagaaataattaaaatactcccttggagatgattactcgaacagtctactacagcatatacaaaagattatatgtaagtgattatggctataagaaaatacaaacccaggacaatcttttttcaaattaaaaaatagaattaactaactcaagagtacagttaaaataaatcatagcctttcacacatgaaaatattaagtctccagtgcttgtgttttcattaatgtttaaagagtggagaaaacttttaacacaacaaagctatttatctaaggagtattttgaaagtgtgtctcagatttgctattaaaatgtgtagcattgtctctttagcattctgagtttaaattaatgctataattataaatatttggtgttgactcatgggaggatatagaaatttattaacagctttatttcattatcagaactcaattatatagttatttttatctttcagggatatgaggattgtctgagacacagagctgacaatgaagtcaacaaaagcactgtttacattattgaaaatgcaaagcgagtgagaaaagaaagtgaaaaaatcaaggtattttttcttagtccactccttttttaatggtaaaaatacaccattttaaagtgtataatttagtgtcatttagtactttataatgttgtgcaaccgttaactctatctagttccagaacattttcatcacccgaaaaggaaaccctatacccataagcagtcactccacatttctccctcctcccaggccctggcaatactaaccttctttctgtccctatggatgtatgtattctgaatgtttcatatttcttatgtgtcctttttgtctagcttctttcactcagaatgtttttgaggttcatctgcattatagtatatagcagcatttcattccttttgatagctgaataacatttcattttatttattcaccagctgatggacatttgggttgtttctaccttttgggtattatgaattgctatgaacattgaattacagtttttgtttgaacatctgtttttaattctttgaggtatatacctaggaggaaaattgctgggtcatattgtaattacgtgtttaactttttaatgaaccactaaactattttccatagtgcctgtaccattttacattcccatcagcaacataagagacttccaaggtagtagtatttttttttttgacaatctcaggcaattgtttattccagttaatcattgtttattatttacccagtaagaccctgtcaaataacatttttgacttgtccatgtcaaacactaattttttggttctcattagattttttaaattaaaaaattatatttttagagcagttttaggttcacaggaaaattgagtagaaaatatagagagtacccataaacccactgtccccaaacacattttctctggctgtcaacatcccacaccagaatggtacatttgttacaatcagtgaacctattttggcacactatcacccaaagtccatagattatattaggggtcactcttggtgtacattctgtgggttttgttaaatataggatacatatccacatagcctacatttgtatatatgtacatatgtatccatagtagtgtcataccaggatagtttcactgccctaaaaatcttctgttctcttcctgttcattccttattccccccaacccatggtaaccagcgatctttctgctgtctctatagttttgcctttcctaggatgtcacatatttagaatcatacagccttttcagattggcttctttcacttagtaatatgctttcaagtttcttccatgtctttccatggcttgatagctcatttgtttctagtgatgaataatatttcattttctggatataccatagtttatccattcacctactgaagggcattttagttgcctccgagttttggcaattatgagtaaaactgctataaacatttgtgtgcaggtttttatatggacatacattttcaattcatttgagtaaatacaaagaagtgctgaattgtatggtaagagtatgtttcgttttgtaagaaactgccaaactatcttccaaagtagctgtatcattttgcattctcaccaacaatgaatgggagttcttgttgttccacatcctcactgggttttgatgttctcagtgctttgtatgttggccattttaacaggtgtgtagtactatctcacttttgtcttaattagcatttcactgataacatatgatatggactttcttttcatatggttctttgtcatctgtatatcttcattggtgagatgctgcttagattttgcccatttttaaagcaggttgttttcttattgaattttaagaattctccatatgcccaacaatagttaaatttccttgcatcatcttatagtaatgatgggaggaagactacagagtgggagggtcaccagtgtttgacatagaatgtcttcctttttctactttttcttttctctattctttacatcctggtcaagggggaacttgtgccgaactaggttaggttaagatctgaagtttttgaaacaactgtagaaactcagcattattgatcagcgtaagaaccaaaggcagactgagtacagtggcttacgcctgtaatcccagcactctgggaggccaagttgggtggatcgcttgagtccaggagttggaatccatcctgggcaacatggcaaaaccctgtctctccaaaaaaattagccaggcagtcccagctacttgggaggctgaggtgggaggatcacctgagcccaaaaagttgaggctgcggtgatccgagatcgagccactgcactccagcctgggtgacagagtgagaccctgtctcaaaaaaaaaaaaaaaccaacaacagtaacaacaaacaaaggctgcctaaatgattcatagcatccaatctgttgttcccagtacactacgtaaaattgcaaagcaggcaaaggcctcttacatctctccctttctttcatttcctctttctgattttgttgacactccaccccactcccctttacaaaggcccccatttttcattttccctccaccaagcttcttttccttgaggctgaactcaaccaggtataatcttgattaaataaatgtgaagctattgtgattaaattattgtgtgagatgctatttgatgtagctgtttctggagtgtaagtgtgtgggaagagatgcttattagccagcagtctctaaatagcagattgcttggctggggagtcgggggaaagagtttgttgagactccttttgagcaagagagagacttggtctgcatccttagtgtggtggggagtctttgaagtgttaaagccggagagtgacttgatgatttttaaaaataaaactggagtgaggcaaaatgaaagcatgaatgtgcaatcagagagatatagcttaggcaaaaaatgataagggcttatattaggatgatagtagtattgataacaataataaaaatagtagtcaccatttatatggtatgtagtatatgccaggcagtctttttttacattctgttaactcatttaaccctcaacaacagccatatgaagtaggtatttttattatcctctctttacagatgatgaaaccgaggcataaggaggttaaggaacttgcccactactagtaagttggaaagctgggatttgaattaaagcaagcctaggtgtagagtccatgctcttaaccacaactctttactacctgtttagattttaagggaaatggatatattcaggatattttttggaggtagaataatcaggatttagtgatttaggatgtagtgggtgagagaaacagaaaaaaaaaaaaagaataattaagatagccttcctggttttggcctgagcaactgagggaattacatagtgctattaaagaaaatgctagtgcttttaaataagatgggaaagcctaggagaaaaacagatttagggacagaggtgggagtgaagagaaatcaggaattcacttttggctatgttaagtttgagaaacctattagacatacagttggagttgtcaatcctggagctcagaggaggtgttttaaatagaagttgaaatttgggtgtcatcagtctgtacataccgtatgatgccatgagactggatggaatttcatacagcacagagaatgagacttataataggacttgaggaattccattgtgaagacactattatttttaatggaaggagtattttttggcgtccgaaatatcagaaactagatatagtaagacacctctcaatcatatgtcatgctttagtgccaaatagaaataaaagttatactctagtacttcaaccaatgaatcaaccaaaatatattgaaatattgtgctgagttacagaagggttacaaagaatgaaagagatggttcatgctctcaagaagttttatagtttagcttagtagtcatgccacataatgctaaaagaataaaaatacaagaccataactggtcagaacccagtgagtgcgtctgaaaaaaaaaaaaaaaaactctgaatttagagaacgggaatgaaaacagttttctcacatgagatgggcatgaaatagattgtaaaattcagagaggcagagtgtgaaaacatatggattggggcagagaatgaggaacaatgctaagaggtaaagaagctccttgggtaaaaatgaggtgttaggttagatttagtaaaaggagttgatttgaacatcttttctaatataaatgtttaatgctataaattttcctccaagtattgctttagcaacagcctacaaatttggatatattatgtttacattttcatttagtttaatattttctgatttctctttaattcttcctcgattcatgggttatttagaagtttgttatgtaatttctaaatatttgggaattttctggttattattattttgttttgagatggagtttcgctcttgtcacccaggctggagtgcaatgccacaatcttggctcactgcaacctccacctcccgggttcaagcaattctcctgcctcagcctcccaagtagctgggattacaggcatgcgccaccatgcccgactaattttgtatttttagtagggatgaggttttaccatgttggtcaggctggtgtcgaactccgcaggtgatccatccaccccggcctcccaaagtgctgggattacaggtgtgagccaccgtgccagcctagatacctttttgttattggtttctaatttaattccgttgtgttcagagagcatattttcattttctcattcacaccctttgtgttattgttgtcatacgttttacttttacattttataaagcccacaatatgttactatttttgcctgtgagttgtcttttttggtaataaaatatataaaataaactttaccatttaactttttttctttgagatggagtttgctcttgttgcccaggctggagtacaatggcgtgatcttggctcaccgcaacgtctgtctactgggttcaagcgattctcctgcctcagcctcccaagtagctgggattacaggcatgcgccaccatgcccggctaatttttttgtatttttagttgagacggggtttctccatgttggtcaggctggtctcaaactcctgacttcaggtgatctgcccgcctcagcctcctaaaatgctgggattacaggcatgagccaccgcgccaggccccatttaaccatttttaagtaaccatttttaagtgtacaatttatttatagtaagtacattcacaatgttgtacaaccatcaccactatccatttccagaacttttccattatcccaaacaaagctctattcattaaacagtaacttcccatttctcccttcctcagccccttgtggcctctattctattaatactttttgtctctatgaatttccctatcctcaatactttatgtaagtggagttgtacaatacttgtccatttatgtctggcttctttcacttagcataatgttttcaaggttgatccatgttatagcatgtatcagaaattccttcctttttaaaggtgaataatattccaatttatgtatataacagtttgttgatccatttatatgttgatggacatttgagttatttctaacttttgactattttgattaatgctgctgtgaacattggtatataagtatctgagtttttccctttgattcttttgagtatataacttagagcagaattactaggttgtaattatctttttaaaacctttttttttttttttaagacaagagtctcactctgtcacccaggctggagtacagtggcacgatctcggctcactgcagcctctgcctcctgagttcaagtgattcttctgcctcagcctcctgagtagctggggttacaggcatgtggcaccgcacctggctaatttttgtatttttggtagagacggggttttgccatgttggccagactggtctcgaacccctgacctcaggtgatctgcctgcctcagcctcccaaagtgctaggagtatgggtgggagccaccgtgcccagcctaaaactgtttttaaaagattaacaataagaactatattttatatttacccacattttttcatttccctatgcagatttaaattttcatatagtatcttattttttatccatgaagagctttctgtagtattttatagtgtaaatctgctggaagtgaatgttcctatggaaaagtttttatctcaccttcaattacgaaaattatttttctggctatatagaattatgggttagaggggtttttttctttcagtactttaaagatattactccattgtcttctgatatgcatagtttctaatgagtctttcatttctattcttgttcttgtgtatataatatttctttgatgcctttacatttttctttctattttcagttttcagcagtttgactatgatatacctacatttttttcatcgtagttatccttctcgaagttctcttggatctattgtttgtcggctttgattaactttggataattcttggtcattatctttttgaaatattttttcagactcattctctctattcttccggtactccaattacatgactattatactgtttgatattttctcctttgagtaatttgttgtttttttaagtacactcctttttctcctgtttatatatcactttggataattttagttgctctgtcttcagaattagtgattatttcctttgttgtacccagtccactagttgaaggaaatcttcatctctgataacatggttttcatttctgactttacattttcatttttttgtagtatccctctgccagcattcttcgttcactgttacatgttgtctaccttttccactaaataccgtaccatttaatatcttttttttttttttttttttaagagacagggtcttactctgttgcccaggctggagtacagtggcgcagccatagcttactgcagccttgaactcctgggctcaggcagtcctcccacctccatctccagagtagctgggtctataggtgtgcaactacacttggctaactgttattatcattttttatagagatggggttctgttaagttgccgaggctggtctcaaactcctggccttatgcggtcctcccaccttggcctcccagagtgctggtaatatagatgtgagccaccacaccccacccatttaacatcttaatcatagctgtttttaagtccctgtttcataattacaaaatctggacattttgggtctggtttcatggactgctttatctttcaatgatggctcattttttgcttgtgtttttgtgcatctcattttttaattgaattttgggcattgtatgtaaaagaatggtattcactgaggtcagtggtatatgtgttctgaaatgggcctggcttcttctgtcaggccactagtgttggcggttgagtcaatctagtcaacagttgggctggctttggtttttgatgtttttaatgtgtcacttaacttcaaattccttaagtggtagaatgccattaccttgagctttgtgtggggcctggtgtgccggagagttttttatggtgttcctgttatactatctgctttcagcaacatcctatattcccgagtcccagaggttgcccctccccgccccacgttcccttgccttttctccagtggtagactgctatttcttgtttgttactcagtgtaaggctcttggcaggaacagaatgatttcttggttttctcattccaatcacaatattaagcaggccatatgcaccaaagcctcagggtaagactttctcaatatcctcccccctcatagtaactgaacttctaccttgtatcagcaccaggttattggtatgataggtttcctgtccaattccctgtagcaggtcccatcccctgtagcaggtcacttttgtttctacctctcctctaacagtagtgatgtttccctgagactatgccagggaaggtttcctgcctttctcctagatgcagatgacatttgcttaatatgagaaaggggtctatgattctggcatggtttttttgtgcctatttcttcacagcagtcaccacctgtatgcccgtgccagtgagaaaggttcttttaggtctcctgcctgtatgctttctcatgaacactcagtagaagcctctagagaagagctggtgaatggttgtggtctcttcttgtctctcaggcttgtagagattctgaactgtcatactagctcacacccagtctttaggaattggttaaaaatctagttgttttcttcttacccactttcatggtagccatctcttccttctatgcttggtcagttatgaaacagttcatctgtcctgtctctcctcagaaacacttgttaccctttgaaattcagttcacttggttgctttgcaacctcagctctctgatggactaaaaaatacgtatttgtttttagattatccattttttcctaatgtttgtaatgggaggtggtgatgttctcttgtggcttttaaaatggtaaatagacctctagagttcattgtctaactagatcatgttattccctgtctttaaaagtcctgtacctatccttttacctttagagtgaggcctaaatcccttaggctggcctgctaagccctttgtgatctgactcatacccatcttgtcagtctgagcttgcactgcagatataggggcctttatatttcatatctgactacatcctaactgttgaaaaaatgctctctttgtgtgttttatttatcaatgcctgagagtcatcttccgacctctaatgggtatctccttcttgtaagatgtgttaggattctgtttgttatctctcttctgcatatttaagcataaattgtggttttgtgtaagcaacataagtgtttatgtaagtgaggaaggaacaatccaacaaaataaaatattatttacaagttagttcaattattgatgctgttgatcttggctagtgattaagattggcaaagaaaataaaattcttcctgaataggtcttgaaatcctcatctttatctgccgaatcatattgcaaatagaagttgggtgttgcatgtattacctagcatttcacagtcagtgtgtctaggtcagtgtgccaaatattgactcccttctaaagtgggttatcttctgcatccagcagcctcttccctttacctgaaggtgctgtacaaaagtattatttataattttcaatatgtaccatggtgtgaaaatcttgggaaggaccagactggaggatttcttatatctttccaaaaaaatgttatgactcttcataagttgggagtaaagtagttgcaggatgttagtaataattataattaacacctttgaagtagttaatatgtgccaggcactttgctcagtacttttcttgtatcatcatttcatgctcacattaattctctgaggtagttgcaatcgtctaagacacttatttaaggtcatatagttaagtggcagagctgggatgagaagtcaggttaaagagtccaaacttttaatggttatgatttacttaaccctacattattaaattattcatgatttcttctctcaggtttttcctttccttgagctttgggtacttgctgataagaaattgtttctcattgctatattaagtgattctcctgacagcagatgaattcatagaaagtgacctatagaaaaaaaaaattcaaatattttgggaaaaatcaatgcctctctaattaactgggattttctgagcactgaagaaggacctggcacccaacaacacagttgttaccacatggcaggcaaagtatgttgaagtatgcgtggtacagagtgggagtgtggctgttcagtgttcatgaagtgcccagtttgtgacatgttgtagattttcttgattcattcatgaagtgataatgtcattgtcttatcaaacatttgtgcaagaaatatcagagagcaaacggatgtcagaatcatttattaaaggtaaaggtcagtgctaaggtaatctgaaagcatcctaagtccttctaaccttaaagaggattctgaatattgagtaatattctttcatcacctttcacatgatgtaggatgctgagatactctcaaagccccagagctagagataatctcttgctaatgttttgacttttgtatgagtgtaatgaatgctttgtttggaatttaaaatatttatatttatttctcaattccaggttggtgatgtagtagaagtacaggcagatgaaacctttccctgtgatcttattcttctatcatcttgcaccactgatggaacctgttatgtcactacagccagtcttgatggggaatccaattgcaaggtaacagactaaaccttgcctaaacattttgatctcaggatagttaatcatacaatactgcctcccatcaccctctaatcttttattttttcttatttttattttttcttaggttttatatttgaaaagagctgttatgtaattgttttttaacttctaagcaaacactcgtgtttgggtaaaagggtggtaattacgtgtggaaaaactgagccccaagtaaaagctaccacaatttttatagcactgcttgaatttaatattgacacagcctatttaatatttagactctaaaatgggagtaatcataggcttaaactgtgtgactatacaaataacttcatgtatgctaaccttacaatttgatctatttttttctaaaatgtatattttcattaaaaatgtatattcttgggatgtaggaaacccaacctggagtaatttgattgctatttaaaaataatacttagggctgggtgcggtggctcacgcctgtaatcctagcactttgggaggctgaggtagacggatcatttgagttcagcagttcgaaaccagcctggccaacatggtgaaaccctgtctctactaaaaatacaaaaaaattagccgggcatagtggtgggcgcctgtaattccagctactcgggaggctgaggcaatagaattgcttgagcccgggagatggaggttgcagtgagccaagatcacgccactgcactccagcctaggtgacagggtgagtctccatctcaaaaaaaaaaaaaaaaaaaaaaaaaaaaaaagatagggtgtagtttggaaaatgtttgctttataagtaagttataaagcaacattttatgtacatataacaaattataactcatttataattgcaagtgacttaaagtaaatttggccaaatgggggtaacttatttccctcatacactttctggcacagtcggttttcttggccatggtccagagctccacagggcatgaagatgtatcctctctatgctgcctttaaggagggttactcatgtggctcacctctgggtatgtccttggagggctcctctgtttgtttattccatctggagttgaggactacgactcagtatgtaaaaaagaacctttacctgttggatgactaattctgtatttcaaaagcatggtaatgacctgcttttaaccttttcaaaaacaaagttataatttagggaatgtcaagatataaatcaagaaatctacataaagatttcctgatagtgaaaaagttgtttggagtaagaaaactttcagatagtttcttttttcagttaagttgttctgatcaaatcagctaaaagtacagaggttttcaaaatcaggagatagttttaaatatagttcagacattgccgtaatatttcccccaagatgacgacaacagctttcccttctgcctaagtggtgcgctctttgagtctgctttaacccttgtttgatgatttataagtgggttcattggcgcctgccttgagttctggatgaatcaagtgcataatatacactagtagaatattctaattatctgactaatgcaagacacgtcatctccctgccccttgtacaaaatgtatccatattgaacattttcaagatcattaattaagctatttgtgtaatggaactattaatgatttttttcttgctgttggcaaaattttagcatttttgtgaccaaaaaggttatgttcaattcatatgtgtatatctccattgccatacactatagtgagcaaaataataagtctcagttctgtaaataggaaaaaaaataaatgtattaactttttcacgtggttttagttaattatatgcatgttgtgaatagaattctctcagctgtccatgtcaagaagagcttttaggtttttaattgtctttgaaaccctccttgcggcaggttatctttctaattatttgtaatatattttcataataataccataaaacttattagtgggaaatgttaatatttgtttattctgccaaagcctcttactaaaacataaactaaatttgtttctgaaatcagttgggtgtatgattatgaaaagaaagtttttttggttttcactttttcttctgctttcaactagacacattatgcagtacgtgataccattgcactgtgtacagcagaatccatcgataccctccgagcagcaattgaatgtgaacagcctcaacctgacctctacaagtaagaatcacctggtttcattttacttctgtttgttggctctgcttctctttgctaatagtattgcaaaagaaacacccaccacttaccagcctactctcatttgtgtttttatgggcgattccttccttctggcagaaaaatgaatcaaatcagccttgttcactatcaacccagaataaatcattgtgggcccaggtatcttatgatttttcttttatttttattacttgtaaacatggccatatatcaaaattttagattatgttaccctgtaaggctgatctatcagactgatgcagtaaccagttaattaaataaaaaacaaatccttttacatgccatctaacattaaagagagaagggggatatcctcttcatgcaattagtaggttctatcctttcttagaatgatcatgatgcactaaagattgcaaataggctctttcttgtccacagtaaacagttaagggatgagtacaatggtgtaatttcctctattttactatacttaggctctctggagtaggtttgctgattattagtcattgtgggttgtcaaaaattggcgtttgatttcaagactggttagttgggttgattagagcatagtactaatcagggtagtgtaacaggttttatccccacgtgggctaattaattttatcctattctaccgttgcagatggcatccattacccatcttgttaatgcatgctgttagtcataatgagtgaccaagtggttggatgtggtttacactaacacctagtagtggaaaaacaaagtattcattctacttcaagaacaatgacctccctccttctcatcactttttctttcctctttcccttcctcttccgtatccaccttgatgataggaactagggccaaaaagtgtaacagttattctctaccttcaagggactcactgtgagcaagagatgaagtaataaagctaagcttatacaaggtgataatagaggtgagtgtaaggtctatggaatcacagaaaagggagtaacttattctgcctgagctagagaacaatatctatacccttgcatatttatagggaaatccccacatttttcagttgctttaagtatgaaggagaatgataggacagggaaggttattccttatttccttagacgattgaattccttgctgtgtgacttcggaataccttgtacttctatcactctagtggtaagcacttgcgtcgtaattgcctatttacttttatagggcaaggagccatttcttttttgcttattagtacatcttcagcacttagtatagcactggcacaattaatatatgatgaatgaatgagcaagccttcatattttgtgtatatgagtaatatatatttctattttctggggaaaatgctgtttacgatgcagattataaaacactgatgttaacgagggattaggtatttttaccttattttgcagaaatacaggttaccatacacctattatattaagtgattgggtcaagctcagtattgagatcaactacaagtcacaggctggacatttccaagatggcattcaagtgttcactgtctaagactagtactatggtttaaagagtggtttcaggaccagcagcagcagcattactggggaacctgaatcagaagctcagggatgggacctagaaatctgtggtttaattagcgctccagtgattctgatgcacactcaagtgtaagaactactgaactagcggttttgaaaattgtattttagcaccagaaacctttcttcacatgatccaagatagaagttacgttatttatataaacttataaaagagagaggtgttgtgtgcatgcatgatgttaaacagaacttgaaaatcaattgagaacctttgtttctgctcctataatcccatcatgttatttaaaaattatatgaaaatgttatacaccttatcaattcaacataactttttttcccccagaaatataataggcttttgtagttcattcacagttttatctatctctgttttattatttgtattttcattcattctcatatttctggtacatggatttcacctggatgtagaaaacacatttgcaattttgttctttttacagatttgttgggcgaatcaatatctacagtaatagtcttgaggctgttgccaggtaagtttgctgtttctttaatttgtcctttggttgggggggggggtctatttttctgttaaatcaactaaaatagccaaatacctttctattatagaaaggaatataggccgggtgcggtagctcacgcctgtaatcccagcactttgggaggctgaggtgggtggatcacctgaggtcaggagtttgaagccagcctggccaacggggtgaaacccaatctctattaaaaatacaaatttagctgggcgtggtggcacacatctgtaatcccaactactcaggaggctgaggcaggagaatctcttgaacccgggaggcgaaggtcgcagtgagccaagattgagccattgcactgtaccctgggcaacaagagcaagactccatctcaaaaaaaaaaaaaaaaaaaaaaaaaggaatataaaggtgaataagcaactaaccttgtgattggtagagttgtggtgatagggtctctgtgttgtggggagggggctgttagaagtaatgcttatggtttccaaaatagcagagctccagacattttggattatattcccaaacctgttctagccatgttatttattatcctcggttgtgaagtggctgacaacattggaattataactggagaacagtgggagagtaattgagaaagtaagcagtgggtaaaatgctggaagaactacctggacttacgtaaaatgaaaggcttcattaaaacgaattgttttatgtatacgaattgtatgtatcagccttcatacaatttatcaagcagttcatacaaaaagggatgctttctttcctcttctatcatcatattaattaccgcaacttttccacttggcctttacagccacactcaaaaagttaaagaaatacagggtccccagtgatcccccaaaaggagggtttattctctccaaatatgtcagtatatttttcccaccttgacgtttgcattccctgtcttttattgatggctgtctgcttttgtgtcttgcgatctgctgctctgttctgttctcgtcttgctatccatgattcataatccttttatccccccccatgtattttttttgcctatgtgtgttgctggctactcccgtactgtgcttccatctgtgctgtaccctcaagtaacttcagagtgaaggacctttcagcttgtcctggggagtaagcatatggtataagtagacagataacattctgaaccccttggagataggtgtgtgtcagggcaaaatctgtccccagagttgttgatgctattggcttgtttggataagctgtgttcattttttatttaggtctttgggacctgaaaatctcttgctgaaaggagctacgctaaaaaataccgagaagatatatggtgaacaatttttaagatacacctatcaaaaaatatgctttgtaaaggctgtgaataaatagtgcatattaaaaagtaaacatggcaggtttgccatttaatttaaacctacatttaggtgttgggaatttataacgtggtaaactaagacgaaatatgacaaatactatatataattaaaattatcctataaatgatatacaactggtgagtggaagagggcctagatttcccacttttatagacttaaaaattcatagagccagctgggtgaggagttggttgacaagttcttagtttttattatattctgtaatttcttaggagttgctgtttacactggaatggaaaccaaaatggctttgaactaccaagggaaatctcagaaacgttctgctgttgaaaagttagtatgcgccacaatttatttagtcattattgattaaaatagttactttcttggtaattccaagtaacaagcataacaaaaaacaacatcaattataatagcaactacaattttaagcacttgtttatgtaccagaaactgtgctcaatgatttgtatgtctgatttggtttagtcctctgaagaacactgtgaagtaattcatgttaacctctccactttacagatgaggaaatggtcttggagatggtatgtgacttacctaagctcacatagctattaaagggcagagtttacttgaactgtaaattcattcctttttgctagtggagttaatggtttggagtcctttagttgctatatgcaagttggttctataatatagataatagtctcctggcacctattgaagcagtgcctcgtagatcctcaagccagttgccactgctatagacctcaccctgtatttggcatggataaccagtatatcactggcaccctttccatagctccacttttaaactgaaagaacctacaccgagcttgaggatttcacattgctaccgtgccctctaccccaaacatttaggattcagggaaatggagacaagatactctttctataagggttgagtaagtaatggtgtgtgtatgtgtgcatgtgtgtacctctcctgtcactttacaggaaccttaataaggtgtgttcagctagtcagccattgcacttgggggagcattggtggtcaataaacagttcatggccagcttttccattttgccacttgaaagtaatgctgcagctatgataactgaggttaatacacaaaggcttgtgctgtagttacgcgtcgtacacagaaaaagctttagatgactcagtagtttaattcatatctgactgatgtctttggttttaaaatccatgctatcttatttttcagatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggtaatttgttttctgctgaaaattgaaactattttttgtgactgagccaaccttcactgaaatgctgctcagggaaacggcaccttttgttagcttctgaattttctctcgattacatggtggctctaagccaataaatatttaagaagatttattgtaaaagaaagaaaaagaaaaacaaagttttttttgtaaaaaaaacttttattttctttattgtaaaagaaagaaaaagaaaagaaaaaaagagttttttttcttttactttaggcatctatgcttgtttttagctctttatataagaatttaaggtgaaacaatttggcaagatgctttgacattttaatgtaataggagtatgtgaaatgtcacgataaaagcataatgaatgccttacatatgaactttgatctcacattcctatcttagggtggagtgagcaaagagaacttaaagaagtgaaaaagtactgacagaagtagtatatactgaagaataatgataaaattgagagtgttcttaaatgttctcacatactgtgataattttgactacagtgatgtagtgttattaggaagttccatctttatagcaagagcagtgttttcagcattgaaataaagatgaaattaattcttcctttatattatattggtctgatgaaattgtatgtctaattagcatgaactatctcttttattttaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggttagagcattgttttacttaaaataatttgtcaacgtagtgaaaatatctttttgtgtagtctggattaccaatatatgtgaccatgtcacatttggaaaagtgattcagagaaaattctttaatgcaggcatgtaatgaaggtaagcagtgttttcatagttacagcatcagttcttttgctggcatttttgagaaggatacaatttatgtattaaatttgaacgttactgaaattctccttggaactgggtgatgttacattattagctattgctttggaacaggaaacagtcttcatcaccatctataaccatttgtggatagaatatggggtagcaaatatggctcttttataagtgtattttgttccataagcaaaattgaccagagttgtcctattgacattttcttggtacatttctgatcaggtagaatatagacctaacaagcagagttatttattccagtacaagaatttcaatgaagggaaaacgtgagggcatgtactcctcaaaatgcattcttctttatataccaatgtaacccagactgtgaccccattctaacccaggtgcatttattttccagtgcaacacagtctggctgtaattcttcaagtgatgatttcttaggtgcttttcttaatagtatcgagaaagttttccccttttttttattttactctgtgtcatgtaatgatctttgtgagctgaaggaattttttggcttgcattttattctcatgacatttagaatgtcaagactgtggaaatgtcatttttgtgactgggagtttccaaattcagttaatgaaactgtgtggctggagcagagcctcacacttgtttaaatggggctgatttgcattcacacctcaaaactcttacttcctggctttaggcctctccgcagtccatgctttctgtttctactcttgatatagtctttgcctaaatcaaagtacccacatgacaactgcagttgaaaggtagaaaggactctccagataccattttgtttagacttgacttcaggacaccagtatctgaaaccatggagtctacatcctgtgtagataccaaggcactaagaatagggcttttcctttggatattgttcccacaaggttattttgttgacaatgtgggctgccgtacctgaccattgtcttttaggccagaagttttcatccagggttagagctatctgagtagaactgctctaatctcaataaaaggcatcaatttgcagagtgcatgagaaaaaattttgagtatacaagccaccttaagtgaacctttccctgacagttaatttagtggttcattctagatgctgagcaaatctgcctgttctggatttagtgcctggctgtatgtgttaacctactcaaggttgagcatgactagcttggggctagcctcaactactattacaaatagaatagccatcattccgaatatgacacttaatgttcactaaaaacagataagatgcccgggtcaggttccatttgatgagactcttacctctttcagatcttcatttcagcagattccatattacctatgggaatgcagtcttcttatcatctagactatgttaatactgcagaaagtaaagtagagctttgggtaatgatctagtaaatttgatgagtgaaaagaagctgcagtcttccttttagtcaccactcctttctcccaccaaaccttgcatttctagctgtggttgtcatttagtcaaatcaagttaatagccagaccatcacttcaattaatacagtgtataagcaacttgccattgttatcagtttgcatgtatagaaacgacctaaatgaaagtgcaaagaagtcttgaaatggtttcttaggccatttagtattcagtaaaccagtacacacaaaattaagtgtaacctgttttttctttgttgagtcaaatttaagatctgtgtaactttttatgttactaaaggcaatgtcatttaattcctgttcataccattgcaagcatttgcttaacctcttttaatgtgacccacactgggattaagaatagaaagatatgtttagaacagtgcttgacatgagaaacaaaaggaagtagactgctcagctcagttggaaaataatgcagtcttttatgattagacatcaatcttttagacaaccaaatgattgtaatccatattgaaaaacccgtggggctactcttctttgtgtcgccttcccatcttgcggctctgcctaatggtggaactttatagtgtgagtatatattctgattccaataatttaagccagtagctgttattcaccttttactgtctgggatgtgtgtgtgtgctaggtattattatgaagtaaacaagaaaccctcaagtttttaaaaatatcactggggagacacacacatcagacctaactatagcaatgtgatcataatcaatcagaaaagatgtggggcagtgcaaagagtctggtgttctttgattttggtgaagtcaacatcagtgacagtcaccatgtatatagcaccttttaggttatagatcattattattgagctttattttttaatctttacattcttgtgcagcaggtatcgttaaggttaatatttgaagttcatagagataaagagattttcctaaggtcacaaagttagtaggtggtggagccaagatggagtccaagtgttccattaagttgaaccattggtaatttttgatctacaaaatagatcatttcacatgttcaacatatacttcagagccttttctaccctacagcagttgtctcactaagagataggaaaagaaaatcttttttctttttttagaaattatattcaatgaaatactaattaacccataaaagttattatgtaaatctatattcttgacatggaaatacatatgtatatgtgtgtgagaaaaatagattacgtagcaaacataatgagattacatttctgttcaagtggtaaatacacattttaccactcaaaatattaacatgattgtttctgtatgatgggattaatatgtgtttcagggaaaactcccaaaatgtgtttttactgtgctctcacagcaaacaacacagagacttctgtgtccaaatgtgggagggagcagtttctctcaccgacaaacagtgaacaccaactgggtgtcctctagttcaattctgtctacctggagataacatcagatcccacagggtgagggcccagtccccaagactgccccatgactcctagacaccagtcacaagtctgggcctccggaacttctgatcgaccagctttaagttgggctacccacaatcccctctttgggtttgattaacttgctagagcagcagacagaagtcaggaaaacacttaacttacgttcaccagtttcatataaaggatattgcaaaggacacagatgaagagacatgtgggacgatatataggggaaagggtgtttagcttccataccttccttgggcgcaccaccctccaggaacccctacatgttagttatccctaagaccctgtttttctttcattattctcacatagccactcaacacttttgacaaaaggtatgtgaagttttttcctgacacaccaagcaagcagttctccagcaaacaccagctgggtatcctccagttcacttttgatactgcctacctggagatagtgtatcatgtcagatctcacaggttgagggctcagtcccataagactgccccccacttcagatgccagttgctaattcaggttgtaacgtatgcttctgattgaccagctataaaatggggtccagtagtttactagaccccctccttggatttgattagtttactagagcaggtcataaaactcagggaaacagtcatgtttactggttcattataaaaggatatgacaaaggatacagatgaagagatgggtgaagtatgggggaaggggcgtggagcttccatggagcttccatgacctttctaggcatccttcaagaaatttcatgtgttcagctatccagaagctctttgaacctagttttttggggagtttatggaagcttcattatgtggggatgattgattaaatcattggccactggtgttaagcttaaccttcagcccctctttcctccttccccaggtcaggtgtggggctgaaaatcccaaccctgtaatcatgccttggtctttccagtgacctgcactcatcctgaagctatctaggggccccgaaccacttgtcatctcattagcatgcaaaaacactgttatcactttggagatactaaggctttaggagctttatgtcaggaaacaggaaggaagatcaaatatatatttatcaaatatattttacaatatcacgcaaatgatggctttgagcttactgatacagaggagtctttttggcaagcttgaagaagaagagaggctgcttgagagtcagagtaaagcagcagcctcccccttcattcctttgtctctgttaaatatgagaatagttaaattaattacagtcgatctactcctcttctttttctgagtatagatcatatattagggcggtggttctgtaaatatgatcctaggaccagcagcatcaacactacctgagaacttagaagtgtaaattatttggtcctacctctgaccgactgattcagaaactctggtgatagagcagtgatctgagttttaacaagacctccaagtacatgtgatgcattctacagtttgataattactgcatttgggtataatttataggcatatacctgtgagattcaacgtatccagattcatactgcccaaactgtttgaaataggtgaataaattgtactttatattttaaagctaccatctttgacactaacaaaagagattctaatgctcatccaagtgcaggagatgaaataatccaggacacccttcagggaaaaatgaaggttaataattttgatcagaaaaaagccccaaagaatttcatttaaactggaagaatctaaatgatacacaagtaataccacttggattaatttaaagagagagttcaaacttggctggcttaacagaaaaaaaaaaagattggaatgctatatttgtgccagtgctgctaccgtgaaaagctttgaaaaataattagaaagcaactactgctgtagttcatctctttctcccttacataataaaaaccttaatcttgtccttatgcttgttcctatcagcccataattttaactatttaagcataaattgccaaaacgaggataaaattgtgggtttccaaaagccagatgttaaaaatagaagagataaaaaccgagataaaatagaaatgctcaaaatgatttatcttagtggcaaatttatttcttggcttatattttccattatttatgaaaatatacttgtgttatactttatctgctttttttctaaatttggaaacttgagtattttcaaaatatgtatagtaaaaagaaagaaatttcagttatggttttgatcactactgacctatactgtatcttccaattaggtaactgttaatgttgttattaattcttatgtatattatatgatgtggtgcattttattttaattcagtatttttatagaaaattttacttttaaaaggggaaaaaaaccttcatcagtttctgttttattttgttacatcccatttaatttattgggaaaaaatttttaatgggtaatgtacgtactagcccacaaagtgtaagagtgtgtgtgtgtgtgtgtgtgtgtgtgtgtgtgagtgagagagagagagagaaataagtggtcagtatagtcttacttcccacttgaaaaattgacttatgtaacttctttacatcaaacaggttaactggctgggcatggtggctcatgcctataatcccaacactttgggaggccaaggcttgagcccaggagtatgggaccagcctgggcaacatagtgagatgctgtctctacaaaaattacagaataattagcctggtgtggtggtgcgtgcctgtggtcccagctacttgggaggctgaggtgggaggattgcttgagccaagaagtttgaggttatagtgagctataatggctactgcattccagcctgagtgacagagtgagaccctatcttaaaaaaggttaacttaaatgagaagcgttcttagtttgataaaatagtcacttttttttttttttcctgagacagagtctcactctatcacccaggttggagtatagtgatgtgatctcagctcactgcaacctttgtctcctggattcaagcaattcttgtgcctcagcctcccaagtagctgggatttcaggtgtgtgccaccacacccagctaatttttgtatttctagtagagacggggtttcaccatgttggccaggctggtcttgaactcctgagctcaagcaatcctcctgcctcagcctcccaaagtgctgggactacaggcataagccaccgtgcctggccaatagtcacatttttttctattcatcttttacatttgagtagatctaccttagacatgtgatagcattttggtgtctttaaaaatactcatttattcctcatttctttggtaatattgtctctgtaattccctgacatttgacaagaagtcttagaaggggtgatttcctatggatatgaaaatagctttgcgttacagcaaactaaaaattagtcacactgaagaaactaacaatatatgtttgtgtccttgttttaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataaggtgcatttgcattattgttttatataagaaaccaatctgtgtatgcatgttaacattccatagtagaaaataatttttaggtggacacatgacatagacttttgtgtttttgttttttttttttgagatggagtctcactctgttgcccaggctggagtacggtggcatgatctcagctcactgcaacctccgcttcccaggttcaagcgattctcctgcctcagcctcccgagtagctgggattacaggcgcctgccaccatgcctggctaatttttttgtatttttagtagaaacggagtttcaccatgttggtcaggctggtctcaaactcctgacctcaggtaatccaccaccctccgtcccccaaagtgctgggattacaggcatgagccactgtgcccagtgactttagaataactattgttggattcacctttcttgttttactgacacttctgaaatttgtaaatgagtagaatttacaagtaaagagaattgtgggaaatgacatttgggtaaaagcttgcttgtctgtatgatcataattttttgtgctttgtcttttaaaatgtaagctcctccaagaatgatgtctgttcaaatgattaaagtctcaggagtgtctaggcattaaattaaccagagtctccctacacttgagctattgctagattgtgaattagatactgaatgaagttttttaggccatgaagaagtcactgctttggcttaggtggtgccacaataaccttaatgagttaacacagcctatagggtatgctagctgagaaccaggaactcttattaggtactaggagaatatatagcagatttgagtgttaagaatttatacgtatctgctactaagtttgttagaagttacaacattctctcacattaatatattttctccgttcactgcctagttaccgggtgatcaaattaaaaataataatcattattttgttgctgttccacagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtaaagtatactttcttatacttctcctaagaaagtgaaatcacaggaggacagaagttatttgtttttttccgtttgcttcagtgaccttagcacatacatctcctattatttaataaaaaacacaactgctttagccaaaaatttgtggaaaattcccacacctaaccagttaagactaaaaagaaaatagttacaggtaggtattacttgccttactatttatgcatgccagccagaagtctgaatgttcatactatgttttgcaaataacataacagtggccactttttgtacaacacatgttatttctgaggtgctcccagcaattttgacatcatttgagaaccgaaagtccagttttacccatgaggttcaagataattaagtggctcaaaggtcacccagtgtgttagccgtagaatcagaaacccaaattgtctctcccttggttacaataattgtggctgggcattgactttctctgttatcaacttatccaggaaaagaaagtacagttatatgttgagatcatatgaaagagaagaaaagcataaacaagcatgagttaccccattgaaagtaatcattctagaccaggtgcggtggctcacgcctgtaatcccagcactttgggaggccaaggcgggtggatcacctgaggtcaggagttcaagaccagcctggccaacatggtgaaactctgtctctactaaaaatacaaaaatcagccgggtgtggtgacacacacctgtaatctcagctactcaggaggttgaggcaggagaatcgcttgaaactgggaggtgaaggttgcagtgagccgagatcgcgccactgcactccagcctgggcaacagagcgagactctgtctcaaaaaaaataataataaaaaaattaatcattctttagagatacacaaggtcttttttattgtttttgataggtacgggttcacatttttaggaaatcgaaatggatatatgagagtagagaaccaaagaaaagaaatagaagagtaagtagctctgtgtttgatgtttgtcatttcttaaccccatagtcaaatttaagtggattcaggcagggcagcaaaggaaatgatgccactaaaaatacaggaccctgctctcccagttcagagttttatgtaaatatagttggggtagaagccatgttacatagaattgcagaaactggagtttgaggtggaaattccaatctggttcacatctgggtccagtagccagaatgagagtttgcctggaatgtttctcaaatttagatgccatttcaggtctctaacacatgctacaggaaaaatcagtgaatatatgtgaaaccttctgctatctagtgtccaagcaatcactctgggattgcaagcccaggcaataaaggcagctttgctgtaaaccagaagccttgtttggttcggaatgttcaggtgtgagcctcggggcaagtactctgatgctccagtgtcttcacatttcctcttttgccacaaagaccctaatgaacaaagccaccttatcttaatggtggattttaattaggctctgtgattaatttgaatttcctcatctgaacttgaaatataattatgttatctgactttcattctggcccctaggatctcctgagacccatctcagaaacctgtaatatgtttacaggtacttgggtaatgcacccttttggagagagattcatagaagcccagaggaaggttcttggtctgactgacagggacccagggtcattgtcagagtttagattctagcccatctgcaacagtgcccacatctggccaacagcaaaccagatgccatgttagatgtcttatacatatactcccgcaagactaatgaccccctcactcccaccaaaacaagctatgtagtaaatactttttttaaaaaatactagttgtttattttcaaggaaatatttcctctcactttttctaataaccaactcttattttaactcttctgtgtctctccattgattagttcagccatccacacacacatttgaccagtctcatcatgtcattccactgtttaaacccttttattggctttcttttgctcttacaatacaatcccaaattccagaaatggctcacaaagatgtgtttccagcccctgcttacctttcttgctttatctcttactattcccctattgatgagttttttgggcattggtgaactacttaaagtcttccatgggccatgtgctctcatgctgccgtgctcattccctctactcagaatgccatggccccctttcttcatcatattacccttgcagaacccagctcaggcatgtcctcttccaggaaacctcctttcagatgacttccttctgtgttcttatatcttccctgtaagtgcctttattacagtatttgagaaactagaagggtagttatctcattatgctctgtctcccttatcatatggtgacccgcataagggaagggactcaggcagattcacctctattccccagcacctagcactgtgcctggcactccatacataaatgctgctaaaataattggcagagtgggactgtttctagacccctccaaatatggcttggtgggacagctctttatcttccatttttatgtggtcattctccttaccattttaagtaatatactgaggggctataaataccccttaactaacactggtgtcctctgacagcatgttctatgttcagagaaattctgagacaaaggaaagtaccagttgtgcacacaaccagtgctatctgttgatttaagatgtttaaatatcttaacatatttctgttgtgctttatttttctcagtatattctaggttttttactttgctcatttctcttaaagatatgaacttcttcacaccttaaactttgatgctgtccggcgacgtatgagtgtaattgtgaagactcaagaaggtacatgtctgaaaagcttgaatttttctctttgttgatttgtaggcttattggttgattcactctttcaggaaagagaatcatttcatgtagtagtgtaggattagtgaaagtcatgcaaagcagtagcttttgcatatgctttcatgtatttttttaagcacagatgttctgtttaccaaattgttagtgacagaacccttgttatgacagggtgtgccttttcttggtagcagaaccatatccctctgccttgggtgttcgaacaggaactgaaaggatgacttttatatggttcagggtactgaccagtctaccagtaatgtttacatgcagccacccagcatagttggatggtttgggattactagcagcagaatccttgagtatagggagttgcttgttatccctcactgaccttcctggttcccctactgcttgacactccctggaaacaggtgaggtagagaggactaagggcctggtttctgggaaatggcattgcagtttcactccagagctcaggttctttgttgagcagagtaaagcttgccctttgcaggggaactggtactgtaatcctgggctccctcatgtctttggaggcaccatggtggtttgccttctgctcagattctgcaagacccatgggcgagcaatcctgctttattcgaaggctctcagatacgtgtgtgtgtggtgtgccgaggtggtttgttttctaaaaatttttgatttatttcccagtaatttacgttttactattaaattttctaaattccttaatgtcagaatgggaggatacagacagatccttgggggaacatatcccacttaattcatactttgtggtgtgattgcaaagtcatgaaattgattttaataagtgaccatggagtttgttttgtgaattttaaaatacactttggatgtgtaagaataaatgaaaaaaaaaacacaacatttcaaatacttgctattcttatgtgtgcatgtccacatgttctacagcaaatggtgaaatgtctgtggaactggtctacaaaggtcattgacctcagagctacactttttaatttgttgacctcggttgtttcccttataaggataaagtgtctgtcttagtgcacaactgtgaatatttcctgggtgtgtgaagtgatctaaagctgcaattataccagcattctacaaagctattctcatcagtaaaaactatcaagccattgttttagaagctagttaatatagtttattcaaaattatttcagcttgtttgagcttgagctttcttcttgacatctgtagatgccatatgtgtgctctaggccatggcttcactgcatttttttttttttaagacacggtattactctgtcatctaggctggagtggcaagattatagctcactgcagccttgacatcctgggctcaagcaatccttccacctcagcatccagcgtagttgggtctataggtgtgtaccaccatgcctggctaattttttaatttttagtagagtcagggtctccctgtgttgcccaggctggtcttgaactcctgagcttaagtgatcctcccacttcagcctcccacaatgctgggattacaggcatgagccactgcacctggcatacattttcagaagaaattcagatgcagctccttgacacaagcccagccctccatgaattggtgggaggaagtatattttaacagaggtgcctattgtaaactctggcttattaattgtgttcataatgaccttgaagaggtggtacatgcctttctgacagactgaaggccaagatttctcattccatttaggtgagtattgcaaggtgtgctcagaatatacaacacttgggtgagagagaccgctttaaaagttactcttactaaaaccacaataccagccttaaaattctaagtcaagtactatggttctttattttaggagacatacttctcttttgtaaaggagcagactcggcagtttttcccagagtgcaaaatcatgaaattgagttaactaaagtccatgtggaacgtaatgcaatggtgagcctatactccttcccccaccaataagtaagcagagaaatgttgaaaatgactatgtttattggatttctgtttaaatgacagtttaaatacattttagcttatttttgtggtctatgttttgtatttggggatttgataatattacttttttttatcttaatataaaacattttcctggagcaagtttcaggtcagaatttgcagccttaaaagacttttcaacaacctttgttaaaagaactgttacttcctttttctgaacctaattgaatgttaccttttcagttgtaatttcttcattttttcagactaaatatgtgtcagaatttctcttgtccatatggctaaagcaagagtatttacagagtgtgtttttttttttttccaactattattagaataactacagatctcctactttactcctaggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagtaactagaaaatgatactcttattattttaatgaccagtgttttgggtgtgatctgccccagattagtaatttaatctcgaagtttgaaatctttagttttattgtttaagtggacttaaagatttatttattatagcaagtatgaaaaattacaccagattttgagctgttagtaggaatgatttttttttaattttttaattaatttttttttttttgagacagagtctcgctctgtcgcccaggctggagtgcagtggcgcggtcttggctcactgccagctccacctcccaggttcacgccgttctcctgccccagcctccagggtagctgggactacaggtgcccaccaccacgcccggctaatttttttgtatttttagtagagatggggtttcactgtgttagccaggatggtttcgatctcctgacctcgtgatctgtccgcctcagcctcccaaagtgctaggattacaggcgtgagccaccacacccagccagtaggaatgatttttaaggtaaattcatgtaacctagaagaatgaatcagttttcactcaggtcttttgaatatttactaagctatccatatatttatgcacatattatcaaatagtcttgacatgtttagggaagggtactacagccattgtttgagctggtgcctagacaaaggggtaagattttcagagataggtgagctgaaaggaaatttaaggtagagtgaacaacatgagagcttaatctaacctggttcaacagaccagagtatgtttttgcatgctttattttattttatttttatttttatttatttatttatttttgagacagagtcttgctctgtcgcccaggctggagtgcagtggcacaatctcggctcactgcaacctctgccttctgggttcaagtgattctcacacctcagccaccggggtagctagctggaattacaggcatatgccaccacacccagctaatttgcatatttttagtagaggcggggtttcgccatgttggccaggctggtcttgaactgctggcctcaaataagcttctgtcttgacctccgaaagtgttgggattacaggcatgagccgccgtgcctggcctgcatactttaaaataatatgcttttaacttacaggctgacctttttcagacttgattgcaggacactgccattgatctgcttgaaataataagttttaaattcttaatatttttagaattttctaaatattatatatgaaaattatgagaattaaaaagttacaaacatatgtttagtcacgttaaaaggtattgaaactctaatgaaattcctttagtctaatttcattgttattctgtggccaaaagaaacccagaggaaagtatcgtttttctcttgtcgtctttaagaattataattaaattcacattcaggatgattggcgttcctctttttttggagggtgggtcggggttatacattcaggtagtacatgtgcaggttcgttatgtggttatattgtgtaatgctggggtttgggcttccattgatcccatcacctaagatattaacataatactcaatgggtggtttttcaaccctcactcccctcccgtcttcccccttttggagtccccattgtctgttatttccatttttatgtccatgtgtacttatttattagctcccacttataagtaagaacatgtggtatttgattttctgcctctgagttatttcacttaggatagtggcctccagctgcatccatgttactgcaaaggacacgattttacttttcttatggctgcgtagtattccagcaatcttgcctgattgctctggctaggacttccagtactctgttaaataggagtggtaagagtggatatccctgtcttgttccagtttttaggggaaatgcattcaacttttgcacattgagtatggtgttggctgtgggtttgcatgtagggttcttattattttgaggtatgtttctttgatgcctagtttgttctcagggttttttttttttatcatcaaggtatgtcaaattttattgaatattttttctgcatctattgggatgatcatataatttttgttttaattttacgtacgtggtgaattacatttattgatttgcatatgttaagccgtccttgcatcccaggaataaaacccgtttgatcatgatgagttatctttctgatgtgctgctggtttcagtttgctagtattttgttgaggatttttacatctatgttcatcatgaataatggcctatagttttctttttttattgtgtccttgccaaatttttattttaggatgatactagttttgtagaatgagttatggaggaatctcacctcactgatttttcttggagtagttttaataagattggtaccaactcttctttatatacatctgatagaattctgctgttaatctctctggtcctgggtttttttgattagtagattcgttattactgattcagtttcatagcttgtttagggtttctttttccttctggttcaatgttgggaggttgtatgtttccaggaatttatccattttgtttgtgttttccagtttgtgctcgtagatatgttcataatagtctctgaggatcttttgtatttctgtggtatcagttgtgatgtcacctttgtcatttctgattgtgcttattttaatcctctctttttctttgttaatttagctactggtctgtttgtttttcatttttgtttcattgatcctttgtatgatttttttggtctcaatttactttagttctgctacaatctttgttactcctctgttagctttgggtctggtttgtttttgtttttctagttcctttaggtgtgacattaggttgttcatttgagatttttctgcctttttgatgtaggcaattagtgctataaactttcctcttaacactgctttttgacatatcccataatttttggtatattgtgtctctattttctttggtttcaaaattgttttttggtttctgccttaatttcattgtttactcaaaagttattcaggagcaagttgttcagtttatatgtactgatgtggtcttgagagttccccttggtattgatttctaattttatttcactctgttctgagaagatgcttctgtatgattttgagttttgaatttcaggagacttgctttatgaccaagcatgtgatcaattttagagaatgttcatgcacagatgagaaaaatgtatgttccgcagttgttgagtagagtgttttgtaaatgtctattaggtccatttggtcaagagtccaatttaagtccagagtttctttgttagttttctgcctcgataatctgtcttgtgctatcattggggtcttaaaatcccccaatattgtatggctctctgtctctttccttaggtctagggatgattgttttatcaatctgggcactctgatgttgggtctgtatatatttaggctagttaaatcttgttgaattgaatcccttttcattatgtaattcccgctttgtctttttatttactgttgttggtttaaagcctgttttatctgatataggaagatcaaaccctgctcctttttgtcttctatttgcatgatagatctttctccatccctttagatttagcttgtggtcatcattacgcctgagatgggtctgttgaagtttttgagacagagtctcactctgttgcccaggctagagtgcagcggcgcaatcctggctcactgcaacttcgcctcctgggttcaaaccattctcctgcctcagcctcctgagtagctgggactacgggttgcctgccaccacactcagctaatttttgtagttttagtagagacggggtttcaccatgttggccaggctggtctcgaactcatgacgtcaggtgatcctcctgcctcagcttccttaagtgctaggattacaggtgtgagccaccacgccctgtctaacagatggtatttttgtattcattgcggcaatctatgtcttttaagtggagcatttaggccatttacattcaaggttaatattgatatgtgaggttttgttcctgccttagtgttgttagctagttgttttggtagtctcaagtatataattgctttataggatctgttaactttctactaacatatgcttttatagtagcaaatatcatccgtttgtttctgtgtttagagctcctttaagcatttcttataggataggtttggtggtgacagattcccatagcatttgcttgtctgggaaaaactttatttttccttaatttaagaagcttagtttagcaggatatagaattattggctgcagttgtttttctttaggaagtctaaaggccaggtatggtggcttatacctgtaatccagtgctttgaaaggttgaggtgggaggaacacttgagcctgggagctcacagccagcctgggcagcatagcgagactccatctctacagaaattttttttagataagtaagcatggtgacacgtgcttgtagtctcagctgcttgggaggctgaggtgggaggattgcttgagcccagaagttacagtgagccatgactgcaccactgctacactttaggtgacagattgagatttttctctcttaaaaaaaaaaaggccaaactacatccccaatcttctggcttctaagatttctgctgagaaattcactattagtctgatgggatttcatttataggtaatttgtcctttttatctagctgcctttaagattttttttttcttgttaaccttgggtagtctgatgactatatgccttggtgatggtcatcttgtgtagcatatcacagttgttctctgaatttcttgtatctggatgttgacctctagcaaggttcaagaaattttcctgaattattccccaaatatattttacatgttgcctttttttcttcttttctctcagaaatgccaagaagttacagattttgttgctttacataatcccatatttctcaaagactttgctcatgttgaaatttttttttttttatctgactggattaatttgaaagactgttcttcaagctctgcaattctttcttctgcttggtctagtctattgttacagcttccagctgtattttgaaattgctgtagtgaatttttcaattccaggtgttctaattggtttgttttattatagctatccttatctttcatatcctgaatcatttttctggtttctttgtgttgagtttcaactttctcttggatctcgttgagttgccttgcaatccatattttgaattccttatctgtcatttcagacttttcattctggttagcctgtattattacagaggtagtacaatcctttgtgtgtgtcaagacaccccagctttttgtaccgccagagttcttacactgattccttctcatctgagggatctgttgcttcttatttttgaatttgctgtagtttggatgagacattttttattttttaattcttttttcccttgaggatatgactgtggtatatgttgtgtatgattgtttggctttgtttctgggtgctttcgacggggcaaggctctatatggtttccttggttgtggatagcttcagtgcagtggctttctcagatgctgtttgctgtagtgatgtattggatgcaagggctgacacactgcctcccgcagggctaagggtgtggaggtgtcagaaagcttagcatgtgtactagcactaagcccttctggcagcaagttatttatttggtggtgcagttcaggcttcagtctggtagatggagtttaagagtaagagtcagttctccctctgggagatgatgagtggaagcacctaccctgagggaaggatggtggcaggggttggagatcaggttggggtatgctgggtcttggggaaaggaacaaggaggggtgcaccagctcctcatcctgtgcaggtaggaagatgatccgcttctccattatgcccctgtcgtagggctcacaatcttcagtttgtatagactttatcctttggttcctggttacattgtggctgcagaccatggatacatctctctgatggttgccaccaaaatgggctttggccgagcctttcccccaagttcagagcagacaactctgcagcttacctgtctgttgctgggatgctgctgctctgtgtagggagttggagttgggccccaccctttgtgaaagcccaattggcctgagctcgttttcagcaggggtagagccactgcgaaaaaggtgaaaagtttctccaggtacatatgcgctaccatccactgggaagaactgctgctggctgcatcaacaacagtgtacagggggtggacacagtgggaaatgacccctctccatgactgttcctggccctcagtgctacccccttcagtgattgtcactgtgcccacatttcttttgtcccaggagggcccttagcaggctgtgcttacctcccccttaggggcagtccatgccgagggatagatctccagggatcccatagctccctggggactcactgatccccatgagcttgccaaagtcagagcgggttggagtatatttgcagggaatctgatggtatgataactcaagggcagagattcccctaggtagggcattggcccactacagcagcacaaacacagtggttcctgccctctaagtttgggtctgaggggagtactgacatgcctgcatgagctggccacctggatctctgtccctgggaagctcctatatcgccactgatggcattgccctaggtaaggagggcagaggggttccccagcagtttgatgatcaggagattgccacaaggtgagggaagcagagaagcatttccacctaccctttacatggggctttgagttccttaagggacagtctctgccagactctcgcttcttcccttttctgtatcccagctttctcttgtgggctctccaacaggtcctggctctcttcccacagttttcagttcagaagatgtccattcaccagtaactttgatcttttttatgaggacaactggcatttgatgtccctagtcagccaccttgaaaacccatgttcctgttcttaaagctcctcaaggatagggattcactaatttccctcatcatctgattagaatgtttggacctttatactttgaatgatgttaagtgatgttaattggtatggttagatataaaatgaaacatgctaaagtgacattgagtacaaatgtttctgaacattttagcttagaatgatgatactcaattctgccattggataccagttacccaaggtgtcacaaacttttcagaacctcattgtttgaaatttgctttaataagtaaaattatgcccgagacaacactcagaatgagtaggggatgtatatgaaagtcaaccgtgataaggtgtcaggactctagaattgctgtgaattataaaaatattctctttaataagccttcctgtagaatctttgtcaggagttttagaagatcacaaggtttcttttgtgttcccaggctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaagtaagaaagtacatcagtttcttatatttagacattggtgtagatgtaaatcacagctgcatatacaaaaggcttcattttctgtaatgcatgattttctgtttgcaggtgttttatccttataagttaaaatcgtccctgaggacttgaataatggcccatctgagattatttggcactttccaccttttcttttaacttaagagaaaactgcacatttcggaaggtttagaaaaatagctcaatttttaaatgtttagagtctaggtattcaatgttgatattctggcctggtccatgttaagaaaaaaatattcctttcacagtctcttaaattgaatgtaataaaatcaatctttatgacaattttcatgcattttgaggttctggagccattttctgtgcatttttataccccagagctccaaatggaatcaaatacttgttaacgtggccactttctttagaggacatggccgctttgactctactttcaactaggaagaacttgtggaacataaaggtgtcagggaaagccactgataaacaataattcagtgcccagagatatattttctatacttcccattgaccaagggtgagctttgtctaaaccaattacttgaatttaccttggccataagcaaattgatttccttttttgaaatgccactggatgtgtctgtactaacttgaaatatccctaagcaatattattttcaatttcttaagcacactttatgttccaggaacagtgttaagggctttgtatgataattattatttaatcatcattaacaacccagttaggcaaccgtattttcttcatttcacagatagagatcacacagctaagaagaagttcagaaagtctctccaattccagatcccatgcttataacaactatgctatatctgtatcctcatcgctaatgtttaagcaagctttaaaaatgattagcccacattcatgaggctgtggccaattctaaaacagctgttgttcttctagtacttgggcatcagtgataataaataggtttttattaattgcctatgagaaactttttcctttagccaaatggtacttctaaagatagtccaaagtatgtgcattttacttctccttttgtcttagtctgcttgggctgccataacaaaataccatagattggatggattaaacagtagaaatttatttttcacggttttggaggctaaagttctgtgattggagtgccagcatggttgggttcttgtgagggcttttttctggcttgcaaatggccgccctctgctgtctcttcctcttataagggcagtaatcccatcatggaggccccaccttcattaactcatctaaagtcagtgtattagtctgtttttacactgctgataaagacatacccgaaactgggaacaaaaagaggtttaattggacttagagttctgcatggttggggaggcctcagaatcatggcaaaaagcacctcttacatgacagcgacaagagaaaaatgaggaagaagcgaaaacagaaacccctgataaacccatcagatctcatgagagttaattcactataatgagaacagcataggaaagaccagcccccatgattcagttacctccccctgggtccctcccacaacacatgggaattctgggaggtacaattcaagttgagatttgggtggggacacaaccaaatcatatcattctgcccctggcccctctaaatctcatgtcctcacatttcaaaaccaatcatgccttcccaacagccccccaaagtctttcagcattaacccaaaagtctacagtccaaagtctcatctgagacaaggcaagtctcttctgcctatgagcctgtataaaatcaaaagtaagctagttacttcctagatacaatgggggtacaggtattgggtaaatatagccgttccaaatgggagaaattggccaaaacaaagggattagagggcccatgcaagtctgaaatccagcagggcagtcaattattaaagctccaaaatgatctactttgactccatgtctcacatccaggtcatgctgatgcaagaggtgggttcccatggtcttgggcagctctgcctctgtggccttgcagggtatagtctccctcctggctgctttcacaggctggcattgagtgtctgcggcttttccaggtgcacagtgcaagctgtcagtggatctaccattctggggtctggaggatggtggccctcttctcatagctccactaatcagtgccccagtagggactctgtatggggactccaacaccacatttcccttctgcactgtccaagcagaggttctccatgagggccccatccctgcagcaaacttttgcctggacatccacacgtttccatacatattctgaaatctaggtggaggttcccaaatctcagttcttgactttgtgtaccctcaggctcaatgccatgtggaagctgccaaggcttggggcttccaccctctgaagccatggcctaagctctacgttggcccctttcagccatggctagagcagctgcacagggcaccaaatccctaggctacacacagcacggggacgctgggcctggcccatgaaaccacttttcttcctgggcctccgggcctgtgatgggaggggctgctgtgaaggtctctgacatggcctggagacattttccccatggtcttggggattaacattaggctccttgcttcttatgcaaatttctgcagctggcatgaatttcttctcagaaaatgggtttttcttttctgtcgcatcatcaggctgcaaattttctgaactttatgctctgtttcccttttaaaatggaatgcttttaacagcatctagattaccttttgaatgctttgctccttagaaatttcttctgccagataccctaaatcatctctctcaagttcaaacttccacaaatctctagggcagggacaaaatgccaccagtctctctgctaaaacatagcaagagtcacctttgctccggttcccaacaagttcctcatctctgtctgagaccacctcagcctgaaccttacttttcatatcactatcagcatttttgtcaaagccattcaacaagtgtctaggaggttccaaactttcccacattttcctgtcttcctgtgagccctccaaactgtcccagcctctgcctgttacccagttccaaagttgcgtccacagttttggttatcttttcagcaacaccccactctactggtaccaatttactgtattagtccgttttcatgctgctgataaaaacttacccgagactgggaagaaaaagagatttaattggacttacagttccacatggctggggaggcctcagaatcaaggcgagaggcaaaaggcacttcttacatggctacggtaacagaaaaatgaggaagaagcaaaagcggaaacccgataaacccatcagatctcatgagacttactcactctcacgagaacagcacaggaaagaccggcccctatgattcagttacctccccctgggtccctcccacaacacatggcagttttgggagatacaattcaagttgagatttgggtggggacacagccaaaccatatcagttagttactctcaagggccccacctcctaataccacaacactgggagttaagagcttcaacagatgaatcttgggagaacacaattcagtttataacagatgcaaatcccatcatgagggcctcaccctctaaaggtgctatcttcaaatacaatcacattgggggtagggcttcagcatgaatttgcaggggaacacaattcagtctatagcaccattcaacagccctgaggacacttttgtaaaagccagggcttgtggaaaacttaatttactgtcactgtctcagatcagcccatcttcctggttatttgtttggagtcgggcacagtctttacttacttacacagggttcagactcagtcacctttgccagcttctgctcctttgccctttccccttcaaatcagcccccaagccatattcatacccccattctcacctctagtgccccacccacatcagaggtctagtacatcatgcatgaaatcccttaagcccctctgccagatgaatgatctttaagtgaagcactgtccatatcatatccgctctgaaaactttggtggttctccattagtcacagattcaggccacaccagaggccttaagtgaccttttcaacctgcttttgcagtgcaccccaacatacattctattacatcacctctttattccctgtttttcaagtcctactttagatattgcacctcacaaagaatccactattctttcctgtgtggatatgtctcaataactggacatcaaccattgattatcttgtttggttaggtagttctctcatgtatgcttctatcaatctaaggagattttctattctccataaaaagattagtccataattctttgtatttctctatatagtgtgcttatagttggtgtttacaagttatttcttcattggttattgagttgctgttttcagccccataagtaagctattaatatatgagtaggggagcaaagaaagagaacacatcatttatgtctctttatttagtgaataaaattatacagcaaaatatttgtaagtataaaatgttatggtattagcagtatacactgaagaaatatggaataaaggaatgatgaggtatattaggccctcactactcaaagcttcgtctatagaatagcagctccattgtcactgggcagcttgttagaaatgcaaaatctcacatcacaccccagacctaacgaatccgaatttgcagtttaagaagattcccaggtgattcctttgcacgttaaactttgagtatcattaaattagataactgaatctctgagatcctgctttgtctaatgcttccactgtagtggttgtcaaatggcacccaagattccccggagcaaaacttgaataaccacttgtttgtttcctaattgaaaaataaaagttaattggcagaattttctcatttgtaagttttacactatatttttcttaaatacttggcacctgttacacatttgtctttcctgacacctaacacctcttagtcctggctacacatgagaaccacctaggaagcttttaaaatatacctatatataaccaagccctggccaaggtactctgatttaattggtctggggataggccccaggcatgggcaatttttaaagccacccagatgatttgaatgggatggctagagaaccactaagctagtatgtaaaatgatacatttaaagaatatatatatatatatatatatatatatatatatatatatatatatgtatgtttgccccaaagccatttgtcttttccctatattgctagggagtttcagactaattgatgatttgtcttcatagcagagtttgactaattaatttgaattccagataccatacgtttcttatacagagtcaggctgcttaacctcttattttctaaacatcaaaaaaaaaagtttatattagtcaaagttcaaccagaaaaatagaaccagtaaaagaatatattgagagatttattgttaggacttggcttgggcaattgtattatctagctgggcaggtctagatttgtgggataggctcttaggaagggctgggactctcaggcgtgagctaaggctactgccttaggaagtctcaggaagtagctaaggctactgccttaggaagtctcaggaagtagctaaggctactgcatcaggaagtctcagctctcctcttaaaacctttcaagtgactgaatcaggcccactttagttatctaggatgatctctcttacttgaaatcaactgcttgtggactttcatcacatccacaaaatacctttacagcatcacttagacaattgtttgattaaataactgggaaatgtggcctcaccaagttgaccttttagaacttgtagtcatctattatgtgcaacttgggtctcaaagatacgattgcaaatcactgttgtgccattattagaggcagttgcttctttagagtgaacaggttgaggaaccagattgatgactccccttatctgagaccaccccctttgttgtttaaaaaaaaaatctggatcctaaacagaaatctgtaataaatccaaacatagcattgtttctctttttcagagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccaggtaactgtgaatattagttaacgttccattctggatacttctatacatatatgtgcaaatgtttatttttttaaaaaattatttcttcttcaaagggccattattactatctaatttcttcctccaaggcttctttctttttgtaatcagactcagaagtctttccccattttgaattaaacttatgctgcaccttgttgtcccctcaatctggctgtcccagttcctcaccttccagacttttttctctgatgagtgctttgtgcctgctgccactgctcctagatcccttatgacattagctctgtgtgttctttctgctcttcttactcccttggcttgcctgcaggtagacctggcccatcccttgtgtagtcttccattctctttctcatttctcctttgctcttgacaccatcagttatatcctccttaaaattatgctttcatggtctctgtgacggtccatggtcctgacattttatttgtcaatgtagtgactttttattttgtgccatcctctattttctccctaattatctgttttttctagggcaaagttttctctccacttttagctttatggtctctctctggataagcaagtctatttctctgactcccattgataaatgtgtgcccctgactttttcttgacattaagtcttctatttctacctgtgtgctagacagctatatatggattccctaccgtcacaaaaattctggtgtccaacacagatcttaaaattttcttcctcagaccagtttggtttttcttttatattgttcttgttaccagtgccacttttctcttgctccctatgtctcaaaactacctttgatccttctcctctccctctatatatagtcgccatgtcctgttggtcctaccttttgtcatagctctcattttgatgccatctttcaaaaccttttactgcccaactagtccaagcctttatgactttacacacagactatttgatttagtctcctcactggtctccttgctttcacccacccatttttaatctctccacactcccaaattaatcttgttaaaacacaactcttcctatcatacattctttttcggacactttcagtagtttcttagtcccttaggatgaagggcagttgagtgaatgtggcgcctggggctccccactgttgtcccttaacatgtctctacaaattttgtactttgtgtccactatcactcctttctctggtgtacattctgcactcctgttggttgttcttccatggtcttccatatgtcatgctcagggcaactttcaaaacttttgtcacatcatttcctcatctggcactctctctgaattcccctggcctaacacaaattttactcataatgaaacctagatgaagggccacctcctacatgctttcttttccagctcctccagtccaaattgcctcaccttgcttctttgtattcactaggtacaaggaaacttagagtctccattacctactttttcatttccatatatgctataggatattctttcatatgtgttagttttgcttcatcagattctttaaccacttcctctaaacaaggggatggctgtgtctgtggcttttcttttatatactgtgcgcgcgcacacacacacgcacacatatgcacacacacacacacagcgcccatcatatttgaggcatttcttctgtctgccttctagctctcagtccccactgcaatcagaggctcttctttcttttcttcaatcttgtaaaactttcttggccccaggttgggaatcagatccaaccagaatacactattcaaaagtatctgtccccttagtcagaggttttcctgcaaaagcgatctctttttttccttacattcagtgtatgctgctcaaattgctcacctgggttctgactgcttcactgccaggcaggtatatgaattcctgaccccatgctgcttcttccaccttaattatgccaccacttgtggtttagtcctcattctgttttatttctgtcactatagttattttttgcaggatattacatacttagctgtcatgttcatgtatgtgatattcaagtcactatctccaatccaaatatttggtgatctactttactttttcagctgtttcccaaacacatattcttgggtgtggcattatcaccccaaatctgacttctctagagtccaaccatcattttccttggcatcttctttttctatgactgacctcagtgtacttccagatttctagattcaaaaccttgaaacctgtgttgccttcccacataccacatacattaccctttcattgtagtcttagtcactaaattttgtctgtttcttattacatcgtcttttccatctattcctttcttttcattacctttcagggctaggcctttcaatagctcattgaactcctggaactagccacctaacttctctctttgcccacagtcttgctttcctccggttcttcctacaccctgctgttgaactagctccagatatttctgtccatgtctcctatatgaaaattccaattgatctgggcaagccagatctattctctcagcatttactgtatttatctggctatgtgctcttggatatgctagttcctttctctggaatactcctttctttctttctcatctatgcgagtcttactaatatttcatgatttagatcaaatcactcgtccttctgtaaaattcctgatcactctggcatgtatggtatcttctcccttctctgacatcctaggccttcttacatggatgacaatatcatacattcctgcacagatgctacattttgttaccttgtattgttaatctgcttatctaatattcttgtactcatgacctaactctactacttcatttatatgctttttaaggtgtgtgatgaaaccttatatctgttttggctcttagcacattcctgtatacaatataaagcaagctattatacttgatgaatagcttttggtaaaatatttttttttttcatgaagctatcctagagattgaagaggtcttaatccatttgatctagggctgagtgaaaaagtccatgtttacgaatctaaatcccttcatgattttatggtccatgattgtatatccttttatctttctacagtggagagttttactctttttagtctatgttttcatgcagaagctgtcacccttgataattttattgccttccctaaaccttgggtgcgtattttttccttgaggtgcaaatcgttactgcacacagtataacaggtgcacttagttaaccattattgtagcctattaaaaacacatttagtttgggttctttaattttgtcttttattctttcacttacaggttatttctgacagtcttctgtaaagtttttaagaagaaccaagttgaggggagggattgggggaagctggcatttcatagtcacatcatttttgtgttaagtggaattggatgtggggttttttgtactatttaatacaactaaaacctgattgaattctatttaaagaaataactgcagggtgccttagcctcatgaattatttttcatcacttcagttatgttgaaaatggattttatttatgttaactggtcagaacaattgtgaggacagtatttttgcaaagcattatttagctactaaattatttttttttaagccgctagattccaaggggttttgtggcttgccacatcaaacagtgattatctaaaacatagggtaagagggcagctgatcacccaatgcacttcccacaagtaactctgccaggaggtttttggagaaccccaaggcagaagtattttaataccagggatgaacattttattcagtacatttatacatcttgaagaaacactcagggaatagcgacaggctttgtacacatatcttggacatctttctgcaaatgtcaacccctttagtgtacctcttttaaaatacagctactcgtaggagaggtcagaccatattgagcagtgagagatttattaaagtttagttggcatccagataggtgcaataatttaacattaggtaagttggaataagggttgatgtgctcctagggaaggtgagagtgtcagcagggaggagagagtagaaagtaaccaaaaacattgttctctgacttcctacttggttctggtggccttatgtatgttaccccaaatcagctttctggcttctactgtcacacattcaacatctgatctgaaagaacacatgatgcaatgaaaaaagaaggaaatgtattgacctctaatatgcatgagaggcaaagtttttgatagttcatatatgcatagaactaggacaagtgggtgctggtgttacattttgaatggctgtgttctgcatctgtgaatttgacactattgtacatattacagttggccctccgtatccatgggtcctgcatccacagatccaaacaactgtggattgaaaatattagaataaaactaaaacaacgaacagtataacaataaaaataataccgattttaaaacaatacagtatgacagctatttacatagcatttacgttgtagttagttactaaaagaaacctagagatgatttaaagtatgcaggaggattttggtatctacgagcgtcctggagccagtcctccaaggatactgagggatgactgtatatgcacaaactacctttctgtttgcaaggctgctatttacaagtgtgaatgaggcataaacccctaaagtagcccagtcttacattcttctttgaccttttttacacctcttttgtatttaatatttagattgtcagaatggtgaagaatttaaaaggcagcccaataactctgtcgataggtgatggtgccaatgatgttagtatgatcttggaatcccatgtgggaataggtaagatacatctaatgagatggcagctgtgaaaagtatcagtattgcttttaggtagtgtggtcttacattctagagtgactgttttggttactcatcttgaatttgaattttggaatgataattgttaattaaatggaggcctcatctgatcatgcaacatgtccatcccaaggtcctaccccatggtagaaatgtagcaatgtaacaaagttaaaggatatttttcaattagccaagtagagtgaatttcccaaagctactggcagcacaattgattgtttagctcttactttgacagcatgcatgaaatttttattgattttctgcccctggccagactgcctgcttatgttgctgtactatatcttttgacatctcaactgtttggggctaagaaatgataattggttggctgtttttcaacatggcagtattaatgggtggtttgggctgtagtgttgaatttatatattgacatgcaacaacagcttttccaccacctgtaccattttttttcccttctctggttgctattaggcaacacaactaactccccagcaagttagttagctagtttgtttgttttggcagggtggtggggccagatatggaattcatatcttgggaattattgtactgcagtttaggttcccaaactgttcttttcatttggaagtattcctatttcttgtgcaacttgaagtactactcattggttatccaagtgtcaaatggcctaaagctgctcgagctcatagaacccttgcgctgctagtcagggtttcatacatgaaagaatttcaccgtcttctcattgaactcctagaccacaaaccccaggtttctgagttcccttaatatagcacctagtctagcgtcatacacaattaagcacttactgagtgacttaattatttttaagttgagtttttttcttcagataatttttaccttgtaatgattgaaataatgattctatttaattgttgtatactgtattacgaatagggagttaccagttaaacttagttaaattatttggtaagtctcagtgtcactgttaaagaaagctcttttggtttttaaaaaaggaaaactaattgatagaattgaactataacattaaaccaagttgaaactgtgaagataaatcagggagtcatttattctagaaaatgctcaccatatagagatactctcttttaggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataaggtatgtgataaaatatatgtaatttaatttctttttaatccagcattggctcagcttggtcatggttttgttcttccttttttttttttaatgctgcttttgatatctcatactgaaatttgcagtcaacaaagcagaggtggtctattggatgaatcagaaaccagaaatgccttttgatgcaaaatttttgataggaatttttaagccctccttattgaaatgtaaattaaatacaataaagtgtattcatcaaaagtgtacagttccatgagttttgccaaatgtatacatccatgtaaccattacaccaatcaaaaaatagaacattttggcttggtagtggctcattcctgtaatcctagtgcttttggaggccaaggcgggaggatcacttgaggtcaggattttgagaccagcctgggcaataatatgagaccttgtctctacaaaaataaaaattttctaaaatgaaatttttgcagtcatttctaattgtctataagcatgtcaaccaagagaaccagtggtaacactttgatatgtgaccttgctggtcttttgtctgtacaaattaacatatgtactttttttatacttttatacactatacactacattgaggtttttacaatttttttgagatataatttaacaaaattcacctttttttaaagaaaaattttcttaaagacagagtctcactctgttgctcaggctggagtgcagtggcgcgatctcggctcactgtagcctctgcctcctgggttcaaatgatgctcatgcctcagcttcccgagtagcacatgccaccacacctggctgatttttgtgtttttaatagagacagggtttcaccatgttggccaggccggcctcaaactcctgacctcaagtgatctgcccccctcagcctctcaaagtgctgggattacaagcttgagccaccatgcttggcctaaaattcaccattttaaagtgtataattcagttacttataatgtgttcactatgatgtgcaaccatcatcattgtctaattctaaaacttttctatcatttccaaaagaaaccttgtacgtattggtataatacatattgctttgcactttgcctttttcacttaatttatgttgtgaacatttttctcacccaatttaatattcttccaaaacatgataattgtgcaacattgcaaatccccaatattggacactgaagtagtttcctcaacaataccttggtttccgttttatcaccaagcattagcgtatacgttagactgagtctgcatacttgttattgtctaccagggaatagaatttaccaaatttcttaattagattctagtttgtaggtagagtatttagtgcatcttccaactactcaaatcatatagtatttagtatataattcaagtagttatgatatttgaatttcataccctatattttataagagttaaagctcagcacctgattttgtgtgtcagttgtctatagtcaaccctaggtctttcttactaactttatatttaaagaaaatacatatttataaaactatgaacccagtttcacaaattttctaagaccctggtagccagtatctgctggtagccaggccaaacactgtggaggaggaaaatgatgataatgatgatggtaacccaatatgtgtaaggtattttgtgagttcacaaaatcactttttaaaaaatgtaatcctcacaaacatcctatgagtcaagtagtagtatctccatttaaaatacatggaaagtagagctcagagagatggtataacttgcctttggctttccatccaggaggtgacagagctagatgttccaccatagattcatttactccaaatccaggactttttatgtgtcacagttagggtcttttgggccttgcacccagtaacagcagctcatggaaataaagggttattctctcttgaccttcacctagtaggagatcccttgaagatttgtcatacagatctgcctagtaatctgaacctatttcagaggcttattttgcctcttttgagttttggcctgcaatttaagcaactgccaccagatggaaggaatgctctgttaaggagagcaaaacaagcgttaaaatggcaaatgttgaccagtggttatttatgtagatgatatcctctgtcttcgttagtatctctaggcccattatcatcttggttactgactcagcagtatttcttttttattactatcttttgtgcgaagaggatttctaaaattttcaactctatttggctgagctgagaagtctttccatcctctcgccattgcatcttcaaattgttattgcccactcccggagtacttcagtgacaggtcttcctgccttctgtttctccatttaatcctccttacataattcaactagattagtgtttaaagaatgccacttttcaacttgtcccttagaacctttactctccaccgtctcagctttagtctggcttttaatgcaccccacagtgtgaccctgtcttaccatataagtttaaaatatatacattcttgccttggttcctgccatcaacatgtcctattcatctttattcatagttcgagttctaagttgtttattcaatcggtgaacaaatatattttaaatgtgttaccatgtgccaaggcctgttttaggtgcttgaggatacaccatggaataagacaggcagtgtcccttttctcatgagacttacattctggtgggtgaggtagatacctgctctcccttctcaatggagcatccccatgatccccactgagctctacctgcttcaacctcagaacacttatttttttcataaactgtgactctaggaatactatggactatattttgcattgtaccagaactgataatgtataaatgagtgttgcttttccaggtgatgaccttgggagctctgactcatgctgcaggggcaattcaaaacctgttgagctcatttctttagaaacatcctccagagccagtagtacattgatcgaaatatcctcagctgtggtagatgttcatcttttgaggttgcatttgatttttaaaaacagtctcaagtctcctagagctaattctggagaaattagctgacagaagggaggagactggttttctggcatgactggaaagtgggctcttgaaggggcttcttgaagagaagttcagagacatcatgaccaagtaacagtaaaaaagctcacagcctgctttgaaggatagcacttatttgaaaattctcgtgctggtagttttgcttaaagacattactttcagtattttataatcacacttagtagcttttactaccttatgaattcccagcttgtgtttcttttctgcttgtctttttagtatttctcaaattaaataataagtcccttaggacagtggtccccaacctttttggcaccagagacctcgggccctaatgctcacttgcctgccactcacctcctgctgtgcagcctcgggggaggggcgggggagccctgacttaggaaaaagaagttgactctttttttgttatcatctgtgtgccacctttgtgtgtagtagatgctcagtaatgatatgttgattgtttgatgaggtagtaataaaggcattaaagcgttagttgatattgttagtgtcaacataatctataataatttcccaactatttattggcattaattgactttaaatgtacacttacagcattgtcagtctactatatgatttgcaaatctaattggtgttaaagatacagtatcattaggtgttcatattggaggagctcatttatttcctggaagaaggacagcaacagattctcataaagtaaataagatcctcttctgccttgatagggcaaaagttggccttaatatgaattaatcattgttttagttgtttccttatgtctgtggaatagaggtttattgcattctgacattagaaggatttaggaataattataaactatttggaatatagtttcccattttagtttagcaagttgattaagtgaaaatgttaatccttgtcttaatttttttttttcagaacctttgtttcattttgccacagtttttgtaccagttcttctgtggattctcacaacaggtttgtttctcaagttattcgttataatatagtttacatttgctgttaataaattacccttatatattagatttctagagattagagatgtatgtacaaagtaaaatgatctcttggttttgacaacagcaaatgtttatgtctttgcttttctagttttcttattgttaccttcattttgaaatgcttttggtacatcctgttggagttgtgataacattaaaaagagtattttgaattttttctttttatcaatgtataaaaagtgtttcataattctaaaatgttatagtttaatatttcatcaaatggaatctcccaactttgcaggctttcaggttagttttatagaaaagcattaatctttaagctagccaagaacctgtgattcctagagaaagctttggattacgtaaagcagctatagatgttttgccttctattgttttctgaacatgtattacataaggaatatgctatatattaacttgatacataagtggtaggatggcgagacatctttgttttaaaaactgaaatggatttggcattgcttctagtgggaggtatagcgaaatacagcgaaatacaggagctatagtactcagtgactcagaaattttataattaatctatgagaagttcagtgattttgccaaactgagctaccacattgccataggtgttaagtttctaaatttcaaaggcaagctttatatatgcttctgtgaatacaaagtacacttatgaatacacttatgtattcttcttgggtcctcctggtaggaagtgattttttcctaattctttggcagttttttttttttttttttttttttacttttaggttcaggagtgcatgtgcaggtttatgtaggtaaactcatgccacaggagtttggtgttcagtttattttgtcacccaggtaaaaagtatagtacctgataggtagctttttgatcctctccctcctctcactctccaccctgaagtagactccagtgtctgttgttcccttctttgtgtccatatgttctcattgtttagctcccacttataagttagaatatgctgtatttggttttctgtttttgtgttagtttgcttaggatgatggcttccagctccatccgtgttgctgcaaatgacatgatcttattttttatggttgcatagtatttaatggtatatatgtaccacattttctttatccagtctaccattgatgggaatttaggttgattacatatctttgatattatgaagaatgctgcagtaaacgtgtatatgtgtctttatggtagaataatttatattcctttgggtatatacccagtaatgggattgctgggttgaatggtaattctgttttaaggtctttgaggaatcatcacactgctctccacaatggctaaactaatttacattctcaccagcattctgcaagtgttcccttttctctgcaaccttgccagcatctgttacttttttgactttttaataatagccattctgactggtgtgagatggtatctcgtttttgttttgatttgcatttctctaatgattagtgatgttgagcgttttttcatatgcttgttggctgcgtgtatgtcttttgaaaagtgtctgttcgtgtcctttgcccactttttaatggggtggtttgatttttgcttataaatttatgtaagttccttacagatgctggatattacatatttgtcacattcatcatttgtaaatattttctcccattttgtaggttgtcagtttactctgttgatagtcatcttcttgtatgcagaaattctttatttaattaggtaacatttgtcagtttttgtttttgttgctattgctttcagcatctttgcgatgaaatctttgccagctcctgtgtccagactggtatatcctaggttatcttccagggtggttatagttttaggttttacatttaagtctttaatccatcttgagttgatttttgtatatggcataagaaacgggtccagtttcaatcttctgcatgtggctagcaagttatcctagtgccatttattgaatagggattcttttccccattgcttgtttctgtcagctatgttgaagatcacatggtcatagatatgtggccttttttccgggctctctattctgttccattggtctgtttttgtatcagtaccatgcggttttggttactgtagcctgtagtatagtttgaagtcaggtattgtaatgcctccagctttgttcattttgcttaggattgccttggctatttgggctcttttttggtgccatatgaatattaaaatatttatttctaattctgtgaagaatgtaattagtagtttgataggaatagcattgaacttgtaaattgcctggggcaatatgaccattttaacaatattgattcttcctatccaagagcatggaatgtttttccatttgtttgtgtcatctctgatttctttgagcagtgttttgcaattttcattgtaaagatctttcacctcactggttagctgtatttctaggcatttcattatttttgtggctgttgtgaatgggattatgttactgatttggctctcagcttggatgttgttggtgtataggattgctactgatttttgtacattgatttcgtatcctgaaacttcgctgaagttatcaggtcaaggagcttttggggcaagactatgaggttttctagatatagaatcatattgtctgcaaacagggatagtttgacttgctgtcttcctatttggatgccttttatttctttctcttgcctgattgctttggctaggacttccagtactatgttaaataggagtggtgagagagggcatcctagtcttctggtttttgagggaatgcttccagcttttgattgttaagtgtgatgttggctatgggtttttcttagatggctcttattattttgaagaatgttctttcagtgcctcgtttgttgagagtttttaacatgatggattttattgaaaaccttttctgcatctattgagatgatcatgtggtttttgtttttagttctgtttatgtgataaatcacatttattgatttgcagatattgaaccaaccttgcattctagtgataaagcctgcctgatcatggtggattagctttgtgatgtgctgctggtttcagtttgctagtattttgttgagtatttttgcatctatcttcttcatcaaggatattggcctgaagttttctttttgttgttgttgttgtgtctgtgccaaggtttccgtatcagaatgatgctggcctgatagaatgatttagggaggagtccctccttctcaatttttttggaatagtttcagtaggaatgctacagatcttccttatacatctggtagaatttggctgtgactccatctggtcctgagctttttttttggttggtatactttttattacctttcagtttttgaagtcattattggtcttttcagggattcaggaaatctctggttttctgactggttcagtcttgggaggttgtatatgtccagaaatttaaccatttcttataggttttctagtttgtatgcatagaaatgttcatagtagtctctcagggtttttgtatttctgttgtatctgtagtatcatctgctttgtcatttctgattgtgtttatttgaattttctcttttttttctgtattagtccagctaatggtctatgtatattattacattttttcaaataaccatctcctggatttcttggtcttttgtatggtttttttgcatctcagtttccctcagttcagctctgatttgggttatttcttgttttcttctagctttggggttggtttgctcttgtttctgtagttcctctagttgtgatgttgggttgttaatttgacctctttctaacttctttctttggtttccttttcttcttcttttcttccctttccctttccctttcttttctttctttttctcttgctctgtcacccaggctgtaatgcagtggcgtgatttcggctcactgccacctccacctcctgggttcaggtgatttctcctgcctcagcctcccaagtagctgagattacaggtgcctgtcaccacacctggctaatttttgtattttattagagatagggtttcagcatgttggtcaggccggtcttgaactcctgacctcagatgatctgcctgtgttggcctcccaaattgctgggattacaggcttcagccactgtgcccggccctctttttaactttttgatgcgggtgtttagtgctataaatttccctcttaacacttccttagctgtgtcccagagattctggtatgttgtatctttgttcttcattagttttaaagaaattcttgatttttgccttaatttcattatttacccaaaaatcattcaggagcaggttgtttaatttccatgttgttgtatggttttgagtgattttcttagtattcatttctatttttatcactctgtggtttgagagtatggttggtatgatttttgtttttttgaatttgctgtggattgttatgtccaattgtgtggtcgattttagagtatgtgccatgtggtgataagaggaatgtatattctgttgttttgggggtagagagttctgtagatgtctgttaggtccatttggtcacatgttgaattcagggcctgaatatctttgttaatttttggcctcagtgatctgtctcatactgccagtagggtgttgaagtctctttggcagtatttttaagagaatgcattcttctcaatgggaatgactggtctctttctcttgaatttgcctttttactatttggtatgctgtctcttacatcagtgccatgtcattagcccagtagtgccagttaagcagataatctttcattataaattaagcatcttgcagtttttggaagtgccatcaaccttcttgtattcaaaattaatagtattagagagtttcgtaagttctgatcaatctgtttttcttgaacattcaaattgctattgagcaaaatgttgctaattccttactttcttggatggatgcaagtattaaaagtatatttgaaattctcttaactaatgtgtagcagtgtgctaaaggtaagttggcttgttctggtggaaatattgttttcattttgaaaggagtctgttgctgtattatccttttaaaatatgtttaccaagcacaaattttaggggaaaaaggactcattccttacaaagccagctgagatttaaaccgtggattgtcttcagtcttcttagattaccttaactgcttatggttccataggagttgatgtttggctccttccgttgctcaactggtaggttcattcatttggcaactatttcttgattgcctactttgtgccaggctaagtgctgagaatattgcagtgatcaaaataaacttccttgcccccatgaaacttgcagtgtgtagtgatagggtgaaagacaacaatcaaatatattatgttgggtactgatacatgctatgatggaaaaaagaaagcataataaagggatagagtgtgactgggagagagagagctgccgttttagacatctgaaaaggtctctctgatgaggtgacatttgggcagagacctggaggtaagggaaggaataacgtcgacatcttaaaggaaaagtgtaccaggtaaaaggaaggtaaaagagtaccaggagagctcaggaggtaatgtgatgtgcaaaatctttatttttgattttggttttgtgctagtgctgaatgtagcaacctttattgcaaatatctttggagtacctttgagtagtcagcctttttcagtccagaagcacattaggcattctctggaacttgcgaggaggactatgaagaatgtagaaatggaccaggattcagattctttacacaaaaagcttccctttctttagcaaaactaggatactaaatgtcttttttttttttttaatgaaaaggaaacattgtaacaggtttcataaaaaagcagtattatcaactttatctgtttgttttggggatattctgtctcttctaattatgtacctaagaattacaattatctgtcatgtgattttaaagtaccatagtgaaacaaaagtagattgatgcttcttttgtttgaatgaaattcaagactaaatgacacaccagtcaatctgagttgtattttttaaatttactcattagtgaaaatgagtagcttccaaagaaaatgtggtgttatgtgccacggactagtcctctcctttgaaaataaaaaggaatgcaacacttttttttgtacttcttaattcagtggaatatctttgctgagcttaaatctttgtttatagaaagtacgttggaagtgtcttttaacttcatggagaatgttgcatccattatcatttgctttgtctctcctgccagccagagttgtagtcccctcctctgggtttccccagctccctgtgtacctctcattctgcctctccatctagaatttgaactccctggtggataggggaggaatcgtctctgtccctagtacttgtcatttagtaggcactcggtaaatgttctgaagtcaactagtgaactaactaatgcaccattcaagtaattcccagccttttgtaattatctttagtagccattgattgaaaatacattattttgttaatttgtgtcatagtttaatgcattttattaagggacatttatacatgtgaaaaatacatatgagtatggggaattatttattcaggccacagaaaatgtttgtttgacaatctttagcactgtgtagataaatactgatgtaaatgctttcatcagaatgaggttcatagaatactttaaattttttcaataaaggaagatttataatatcagagcaggcctttataaatgttatagcttccgatctatcctcattcatttattcatctagtgtttattgattgtttttgtatgccaagtcctgttataggagctcaagattgtccaagttctccagtcaaagacccccatgaacacacttgtagttgatcaaattaggtttattactcagttcaggaaggaagaacacatgccatgaggaactgtgggacttctcaggaagaggatgttagaaaagacttacacaatttggacttgaaaatactaaccaaaaatatgtaaaatattaaccaaaacatttgtgacacaggctggctgctgcctgtatttagtttctctgaggattcctcacttatacttaatggtctttgctgaagtaactccagaatagctagttttagctactaagcaatcttgaaaagttgttcatgtctattagaaatgcagcttatagcatgtaaacattctgaataagattctgttaaaggggaggtgtattaatgtgacacatcacaatatgttagtttcttttttatagttactaggcagtgaccttatttacagattcctttgccactaccaaaagcatgtaaaaaaatttcttattttagctagtaagtttttcacatacataagtatcatcttgtagatgattgttacatgaaatttctttctttcctctgttgtttttcattttagccactgtatgatgctgcttaccttacaatgtacaatatctgcttcacatccttgcccatcctggcctatagtctactggaacagcacatcaacattgacactctgacctcagatccccgattgtatatgtaagttaaatatatagttaaaaccccctaagactttcagtgttgtgattttcattttatctgcagatgggaagaacacagaactgtgcacttggtttgtggtatgattatatggttctgtttggaatttttagctattgaaagcagactgctcaacaggaaaatgacatatttcctaggtgtgggttctgtacttgaatatatgtgaaacatttagttcagagtcactaattcctaaaacttgaaactatattgtcatagtgttctagtgtctcatgggaagacatgatattttaactgcaaagaaaaaaagcatacacaaagatcttctgtagtttagaatattgattcctacttgttgtagattgaactgatgaagttatattaccctttctcatgtaaactgcacccatagcattagccgccccacaccccacctttgttagccccattctaaaactgttgaagaaaataatggactcataagccattgtattcattttgtgtcagttgaaaatggatgcttttctctgtggatgggggacttggcactagccccagttgtttaacttatgatttaattggatttttagaattgtagcctacagctaaggataaagatattaatttatagcagattgtaagcattgctaaatagtaggtagcaagtgcaatagagaggtttggatggtttatttgtatgaaatgaagatacacaaatttaagggattttttttaaccagcatgactcataaaatttacatttagcaattgttagaattacacagttgtgaaatttatcattttaaaggtctttattaaggaaaatttcagacatacataaaagtagagagaatgctatttatataatgaatgaatgtaaatagttgttgaaccactcagcttgtcctaaccactcagcttcaacaactctcaattccttgacattcctattccactgataaccccgtctgctctatcacaggcttattttgaagtaaatctcaaaaacagttatttcattatgcatctcttaaagacaaggatttttaaaaataataataccctatcacttaagtccttaatatcaaatagtcaatggtcacatttctccagttgactcatttcttttcatagcatgcttatttgaatcaggatctaaagaaggtccacacattgcaattggtttatatactttctgagtctcttttaatgtttaggttaaccttgcaatttatttgtggacaaaaccagattatttatgttgtaaaatttctcccagtctagagtttgctgattgcatcttcatggtgtttacatgttctgctgatcctatatttgttgtaaatgcataattagatgtagaggagaatcattagaactttggtagaaatcttacaagcatcagctcctactacactctttttgaaaataaggaaccagggccccgaaatgacttacctaaggacacagggtacaaccagatgcaaaatgaagatcagaattcaaccctcttgccagtgctttttccagcaagccagtggttttaaaacattgttttaactgtagttgtttccagacaacttctaaagtgaagcccgatagtgcagttgctctggttgaaatggggtttgaggagtagtaggcagaattcctcccattccgtcccaccaagagctcagactaacacctgggctgaaagcctctgctacttaccaggtgaccttacccaggttactgcaatgtgcctcagtttcaccttcagtaatacatgggcaacagtagcacctaatcacaatggttttgtgaggagtaaatgagccactatgtattaaagaacttaaaaaaaatagtgcctgacaagttttcaagcaatgatagctattaatcttattattattctaacaccctcctccagccttcagagctgtgctgaacacttgtataaattaagaatgtgaaaaatctgcaaaaagctgttgagtacaaaatatcataagggtttccataaggttttagtgactgtgctaggtgtaggtcatgatttattgaattttgcgtagacttgccacatctgatgcaaaaataaaggccatggcatacctattgccgagcccaaagtgcggctttcctttttgatctcatacttgcaagttgtgaatgcctgctctgacaagacactgctcttggcctgtcaccagactgtagatagtttcattactctgactgttcttttgtgaacatgaagccctggtcttcctatatggctctctgtacagtatgccaattaatattagcagtggcgttgtgtagtgtattatagattttacctttggtgatttagtgacttgggtattaccaaacacttggatgtgagatgacataattggatgcttttatatttttaagagaaatgtaagaaataaactagtttttctatagagggaacaggtgtaatttgtttcttctacagctttaaaaggcaaaagaaagggttctggtatacctgctgcctaccataatacggaggtgctcaggcctttgctgctcatcaacctctccccagatcttgattctctctcatgctgtccttcatgttgattgccccattctgagtttttgacagcttctttattcgaatgcagctagaaagcctgacctataattcaacatatcatgctgctcctgctcttttcccccactgaatgtgatataattcccatcgatggtctgtaaagacaggaactacttcctgcttttgccctttcttccccagcccaagtcagtgactgtcaaaagccacattggctggcagttgttgggcactgcctgcaaggatctttacggaggtgccttacctgtggttcctagttgccttggaaacatgacttactggctatagggagagcttgtttctgggaagcagctacctcattctgccatttttctaggacagagagcataccctgagtttcagatcgctgcatgtacctggaaaccctagtaggtagaagttgcataattgccatgtgcacgaagccccacagtacccaataccaactgaacaaggattagttgcatttatattacaaaggtgtttcttacttgatacagcccagtgacattcttggtagtattagcgacaagtatgttatttgagtaattagatatcatttattaaatgttaagagcaatttgaaatagaatccaaaagaaacacatgcaccaacccatctttttctgcagctctgctccattagaattggtagccttatttagcgttctgacttaggctgagaaggttgtgctatttttgacagatttaaacttaatctatccacctcccatttatcaaagtatcattatacaactgcaaacatgttatttgacttgatggaaaaatataaagggcaccgtaagacctaaaaaaaggtgaaatttccaggagtaaatcttgattaaaataaatattgtaattgttcttggaaagcttggtagcttggttgagagcatatgctctgaagtcaagtcaatccaggattgtatattagctcagtctgttaccaagtgaactttggcacggctgctacactagtggttcccagactatactgcacattgaaatcaactggtgggctttaaaaatatcctgacctccaggttataccttatgccaattaaatcagaataaagatggcagccaggcattagtagtttttaatgatcctcaggggattccaaagtgcatcaaagtttgggtaccattgtgttacacctttctgaggctccttattattagcaaatgtgagtggtagtaatacctatctcatgtttttatgtggataaaaataatgtctgtaaaactgtgaacccagttcctggtatataagtaccattaaatggaagcgaattattattgatgttattgttgtcagtgaccaaaaatttggaagagtttagagagtttactccagtggctgagtcaggagatgattgcatgaaggtcagcctttggctcagtctgaccctttaccaaaaatctgtcaggccattaagggtagcccccttcattataacagggtcaaattccacgcccacctttgacatttcactgtatgtttaaatgaaaagtttcactaatggttttttccccccatttctcaataggaaaatttctggcaatgccatgctacagttgggccccttcttatattggacatttctggctgcctttgaagggacagtgttcttctttgggacttactttctttttcagactgcatccctagaagaaaatggaaaggtaaaaagaacctgtcattacatcttttggtattataagcatggcttgtctttttcccataggtgctggatttgtcatatacatactctagctgtaatcattttacaaactttttctgaagatacagtagttagttctcacagcttctttagaacaatagaagtgaaataagaaatcactttctgtgcatggctaactagagagcttatgtgcaaactttctggaaccttaacttggctgtaatttttactagatgaacagagttcttgggacttcagactcctgctctttgatgtgagaaaggtttttcccattttaaagtaaagcctggccgcattcagtttttactcatagtggccttccatgcttggagctgaagcgggtagctgccatatctttggagtgttggcccaatatgtgaagagaggaattctcttctctccctcctcttcccaatggaagcacagtattctgcagaaaggctattctggtcctgccagtgtcttcccagaacatgactatctcattcagcagttgcactggggtaattttgccctggctgtactctaggagaaaattactgatggcggggacagctgaggcctttttctgcagccacacaataggaaaacaaaaacactaccttgcatactgctttcactaagttctcctttgctatttctgagattcttcttttatggtcattcattctttataatcataatgtgaaggaaagctaaggttcaaaaagaatttactgaggatactatgtctggaacctggtaacacctgttacagaagtaataggttcagtgaatttgaatggtactttaaaattaggcactacagtcaaaacctctctaatttggactaacaaaaatcagtttagtatgaatccatgaaaattattaatcataaagtacttgttggggaaacacagatctgctttaaagtagtcacatgtagaacttgccaaagagaatgtcctgctaaatcctgtgagtacttgggaaaatcacatcagtttcccaggtcagttttgcccatcagtaagaagaatggatttgattttatgatttcctggcctcttcagatttataactgattgtgcagctttcactttttatgttagttttatttggcagacagattttatgtagctggctactgcttaaaaggagtttgctccaaagtaggcagatactctcctatagtcgatgtgattcatttgctcagcaaactttccaggtggtgcatgagagcatcaattcagcgtctgtttaattcattacccattttgagttcataaagtccaaattaataaggttttactgtatatgtcaccatccctctaaatgtttgctgaaattacagtaagtgtatgaattacttttagcaacaaaacataacactcatgtatgatttgagtgaatccttttttttgcttctattaaccttaatttttgtttttatttttttgaaaaaaccttttacatctcattttctgttttaatgttacgcattcagatcttgacagcatttggtaagcatatgtgccattcattgccatcatttggatttatacatggtatctgcttttttttttgatgtgcacatgctgatagctcttgtatttacagccaaaaaaatcagactcatttaaaaaatgtgaatccatttgtctataaattactgctcatttgagaggtttagttctatattataggaaaatcccatatcaaattctttagagacatgaatcatccaaatgacttgttttgatgaacattgctgttagtagagtagttgccttctttggcctttatcacaacagtgagttccctcttcagtgctgcatggagtaatagaaataaaccctaccagccacaggtgtggtgtacctttttgtgaaaattggatcacaggaaaatctggcattgtggcctgatcttactgactagctgtttccctaaacaattcatacaaaaatatttggcacttacacacaggattcaacttggctttttttttaaatgaaaaaatactaagataatacttgtatatacatggtacatgtaattattaaatgtttttcaggtatacggaaactggacttttggaaccattgtttttacagtcttagtattcactgtaaccctgaaggttagatttttacttattcatgtattttttaatactgtttttataatactttcttgtcttatcctaatataccatttttttgtctcctttatttcttgttatgggttgttattcaagtgtttgccttaatacttactaaaatgtgtatgatactagggatttgggtatttgtatactattttttgatcagttttttccccagtatatcgtaatcctctttatattgttttacttaaaaaaattcaaacaccatacttatgtcgaaaatctgtttcttctttattgctgtttttaaggcgttatgataagtggcatataaacaggctgtgggtgagagtgagagagagagcgagagagagagagagagtgtgtgtgtgtgtgtgattatgttaagtacttgaatcttctaaaaattatacttctgtttaagaaccccaggcctaaaataggtatatatgagcaagataatatgtgaaaaagagcttggtagtagtgaaatcttataaaatgttttcatcactgatggccaggttggtggctcatgcctataatcccagcactttgggagaccaaggtgggcagatcgcttgagcccaggagttcaagaccagcctgggcaacatagcaagaccctgtctctatttttatatatatatatatatatatatatatatatatatatttttttttttttaatttaaaaataaatataaaaaaataaaaatatataaaatgtattcatcattaaaatttacccatgttagtgataaagtgcctaagaatataatgcaggtaaacaaaagggaggtaattttggcaaaatcattggcattgacatgcagccatgtgataatgctgtgaagcctcactgaatgctacccttgaggcccatgatttgggaatctcttatagttgaaagcataatcaaattatttttgtcattccaataataaacacctcacatgggttccatgagtaaatacctttaaatgaattctggcatgcccaggggttagaagcagaattcagaagtataattgtcaaaggatctctcttacctttccctctaaatttttgttcctggtttatttcttataccagatagagctaacatatgtttgctttattcatctatttcagtaacattttaggaccttaaaaggacattacaattcatctcagtatagccacttactagctgtgtgtccttcggcaagtaactttacctctctgtgcctcactttcctcttctataaaatcgagatagaagtagcacctaccctttttgaggactcaattagtgaataaagcacttaggagggtgctcatttcaatatatgctagttttcggtttttattatgtctcacagtatcacaatttgaaatggacgcctcccccctccttttttcccctggccttgcatatagccacagggcttccaaatggccttcacagtgtttttcaagtgtatctcaaagacttccactccctcctctttggattaatattagtattatctttggattcatattagtattttccttagcaaccagaagaatagcaattcaagactgagctacattaataatgttatcaacatcctgtttataaatgagaaactataacagagagctgatgaccatggtgtcacagcaagtaacaaaactgagacaccatctcctctataaaaattaactgctctggatattagctcatgtgacccagaagttttaagcaagcgaaatagtccatacttttgtttttagatcacatttgaaaaccccagataccacaatctgaaaacatgattggtcctggcagaaacatgaagagattaaaatctaactgaatattttattaatttaatggactagatacaggttttgcaattggaaagatacactacatagtcaaacccatgattcattgctacatgatgttagatgtatagagcctttgcatttagtgactcccgtctgttgtgtttgagctttcacgacacctttgaaagttttgtagtttgtctacccttcctagctaccccttccctctcctacttcttttcagcttatctgcccccaccagctaggtctccttttgccatcatcttcctggctgccattgcctgaggacttggggcttgggcctcctagatattaccattacttcattccttgcccattccccagtactgagatatctgcagccctacacctactagctacttagcctgatcacacctccagcctgtacgccagtttagaggccttagggcagagctcagctttctcacccttgttctttgaaaaacctgggttctgtttagttcccctcttctctggatccctggcccaagctagatcctttcataggtatcattgtgtactagttatcagatactatagcgtattgcctggtgcaattcgtaaccgtcgtgaaatcttttgtgttgtatcttttcagcttgccttggatacccgattctggacgtggataaatcactttgtgatttggggttctttagccttctatgtatttttctcattcttctggggaggaattatttggtaagcaattgtacatgtgtgagcaatatgtaaatagcaaagtagatacatgtgtatgtacactatatatgtaagcattcattatactttaaaaattttaattatataagatgacacgtctttaatattaatggcctgaaggttatttgttagctggtagtgctactaatttcaggtaagattttaaatacacatatatagactgcacaagtcactcagaagacctccctttggtagcttctgtctgtttgaaggtgttgtaaacatctctctagtgaaactatagttttcagcacaacctctcgtgattttcagaggaaatactcatcctgtgaagtttctacctgatatattgaccaacagatacattattgtccatttggacccttattttctcttgatagtatataaccatgattcatgttactacaggtgtgctcagggtataggatatatacaacttaataattcagagggttgtattttgaaattgtcatcttactgttttggtggaggagggaagatgtagaaaggcagactctgcagcttgtctttaaagttcatttagttcatcttggttcagtagatagatgtttgttcagaatcagttttgtgcttgagactctatgggttagagagatgactagactgtactcaaggagaatagagtccagtgagggacacataagctgtgattgggagagttatatatttgcatctcctttctttactcccaaaaacatatattttatttttaaatgtcagagttgttttttttagtgaatggcttcccctgacaaggatgccagcagcagagagcatggctagagcaagccatagtgtaagatttcaggagtacatattttcattgctttgagcaaaatcttacatacaaaatgattctattttatcacagagatgtgaggcttatgtttatgtcccttgagtcttaattagaagaaactctattttgaaaagctttttaaaaataaaaaccttaagaaataaaaatatgagaaacctaatcatttaaggaagtaccagctttaaaaagtataattacagcatatatttggtacctctataggtaattgagagcaatgaagctggaagaagtctctattttctttaataatataacaaataattcaaagttgattaagaacataccatatacaattgtatgtctgcccagagtaccataattctatgaatctatgtaatcagcatctgaactaattatgcaaaatttctacaaaaataaaatgtttccagcgaactcatttccaaccctttctacagactattccttattgatgaaaataaatccagtaaatgattatggtattgtcacacctgtttattcattagtgctactaaaaatgaaatgttaatctattttttattttattgcctgaagtattatcattaagtagagttgagccactgcatgaatataaacttataaagcaaccagtaaaatgtgactagaaacaatgtgaaacttcagctgaatgtggtcacaactgatgtctctagacatgttttaccctgaggcattgagtcacacccgtctttggggttgggtagtgagaatgatgacttccgagccccaaaccacatccagaaataatagtgtttattttttactgccctactacaaaactccatagatgacatggaggttaaaaaaaaaaaacaaaaaacaactggatgcattagtcagaaggtatgatgccaaggaacactctgtgactagctgccatttgtcatctgggcccctgttatggctcagttaactgcctagaacattattcaaggtgttcttcagaatttgagtgaggtagagttctgcagaagtcttttccatgtggcagacttttcccagaaagcctgtgtagcctaggcctcataaatttttctaccttcctgttctcacttttattccacaatctaattttcataaaagtagagccacaaactcagttttatcatgttacataagggtgcatagacattaatttttaaatgagaaaccaaattatcttcaggaagcatgatgtgtcatctaataaacaggagccatggttatctacctggagctctttaatcctagggcagtctgatgtgcatcctgtctttaagcaaccacttcttccccctcaccttcaaagaacaatagcttcacctactgaggctctctgtggttcagctcagacagaagggaagggaaacaggctgtgcttctcaatggccactttacaatgaagtggatgactcagaatgaaatctaactccagaatgggggttcctgctggatttctggattctaaggcttaatgtccaattagcaatattctactctgtgtcaacctatttggcacatactgttaatatatatttgtggatgacaatggtagattccttccatttgagagagatgataagcttctactgtcctttttatatttacatagtgtttttattgggagagagttataaaaatgtcttttgaatttctgaatacagaacacaaatccatccccatcttaataaaacagctgaggaaataaaatgcttgttaggataaaaatgaaccatttctcttgaatatcttttaagcaccagcattttctaatgcacataaatagtcgccagttggcagctttagaattgattgcctgattgtcttcaagtcaaatgcattttatcttttttctcctttgattatcattcctttttttccaaacatttggtaaatgaaatttgtttattactttgggatattctagagaaaattatttttattaatgtatgtaaggaagattctttttaaatacaaacgacattttaattaaatgtccatttcatatgacaggaattgatttgtttttccatcatgtattttctttccactgcaggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggtaagaactaagtttatcttacaacctgatttttggaaggggcctcaatatctgccatgagctaaaaacctgatttagaaaattacattagttacagcatgttaaacccctccttacaggttcatcacttaatttcctcttctgcataaaaagtatagtaaaaacttcgttatccaatgcaggtggtaagtagattccttaatagtgttctatgtgaccttcggcaatccatatggagtatctcatatgctccatatggaattttaaaaggaaaaaattattttattttgtatttagcctagaattttcacaccaggaatttccacaccaacattttcgctttaaacttagaaatttccctgtgggctgtttgcagatttttttcagttgataataccaatttgcctctttcaaacctttccccttcctttaattatagtgctgcttaatctctgcgttgcttctagccctgtctgtccagcagtatatttgaaccaaagagaattccctggatgtggttttgacatccttagcctctggaacacactcgtaaaaattcaagatagttttatgagtgtgtttttatttttcctattaaattgtaaatttcctgtgggaatgagaagttattttttctgctgcctcattatgatatcttttaaacattttttaaaaagcctttaaagcgaaatagggagatgagcatggaaaataaaacttttggcagattttgaccaacaggctaattaaatatgtcatattcctgccaacagtagctgattttattaaacaaaactgtttctgtcatattgacaccaactagatcttgtagcacctccaaggcagtattttcaggtaatattctaagctatgactacctgacttatttgataaatttgtcaaccagtttagccacaaaactgttacatcatgattttgtttttgcctgttgaattgatagaatccagtagttgatattacatagacatggggatctgaaatgattagagtaggaaaaccttcagtgattagaattgtaaaagaggagattcatgtcgcaagtcagtgtcagccccaatcaaaaacaagagaactgtcatagggtacattgattcttcat

SEQ ID NO: 1224 - DNA, 211 bp, mus musculus; identical to SEQ ID NO: 1221

SEQ ID NO: 1225 - DNA, 211 bp, mus musculus; identical to SEQ ID NO: 1221

SEQ ID NO: 1226 - DNA, 22987 bp, mus musculus
gcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggtgctgttggcccagaaagccactccagggcgggggaccggggagggccccgcccgaggcccgggagggcttgctgcggaagtccgcggcgccacgcggccaccgtcgccggttccggctgcgccctgttcccttgcagcagggggtgcttgtggatcattcatctttgccctttggtgtgccccaggccttcgttcttgctgtctccacggcccgtgcctggtagttggggccagcaccgcctgtggaactgcagtacccgcgctgggcgctcggagcaagtgcagacacagaggacccaggcctggccttagggatcttgcggggtctggggggacagatgggcagagcctcgtgccactctgtcaagtcagcgagactagggcttggtgtcagttggtgtcagatgccaggggtgatagcctccagaagccctctacagccccacaggacagagccctcactgcagcagtgaggaaagctggcccacgaggttagggagctgtcccaggtcccctcggcccgctcgctcctccccccagacactcccccatcctgtccgcgactggctcagtggtccctctccctttccctctcccctttccctcagtcccgaaacctaggactctctcttaagtcttagtctcaggcgttgctcctaggtcctgctgccacaagagcccagagtgggagtacttgaaagaggtggggtctgcatgccgcgggagatgtggggttaagaatggggggacttgaactcttggcaagatggcaggacgcgggtaaaggaaagggtcctgggagcttgcagatgtacactgaggactgggcgcggcggcccacgcctgtaatcccaccactttgggaggctgaggtgggcagatacctgaggtcaggagtttgacaccagcctggccaacatggtgaaactccgtctctattaaaaatacaaaaattgtccgggcgtggtggcgcatgcctgtaatcccccagctaccctgggagctgaggcaggagaattgctggaacccaggaggtggaggctgcagtgagccgagatcatgccactgcactccatccaggctgggcgacagagtgagactccgtctcaaaaataaataaataaataaaatgaaatgatgtacactgggactttcagtgaatgttgctttccttttccttgcttaggacctaaactgccccttcctcgagggtctgtatatcacagagccaaagacaattcaggaactgctgtgcagcccctcagagtaccgcttggagatcctagagtggatgtgtacccggtaatgcatcagtttcttcctcttcccacctggggtgtgcatgggcgccagccagccccacctggggaagatggggtttgtggttactgtgagtagctgtcttcccagagggctccaccccctagcctggaccctcgtgagaacagctgtgtaggtaaggagtactggtgacaggcatgatcaaacttggggcaaagtggcccctggcggtgctgggctagtccagccacccctttgctgcagtgctgaacttgccctcagcgtttgccttgccttatgagtttggaggttcaggactggcaggcacctgagaaatgctccattccagtcctttccttctcagacccggaagccaagggtcaggctggaggcatgaacagtctctggtctcccagtggaggagtgacaggcagggccagggcgtgggctcctggctgggtctcagctggccaagtggtcctcatgcagtgtcacctcttgtcagcttctgtgccgtgacccgtttcccagtcctctggtgcctttgggccagggtgtagcatggtgtgtgcctggcaccctatgaagcccatggtgacagggtgacttcctgagtgatggtggaggaaatgatccagagtgtcccattcccagggcagacatccttcccctggtgacgtagtccctgagctgagggtctgtctcactgcctcacagctgtgagtggagaaggctttccccgcctcccacagagcacaggctcctgtgggattgggtgtgtgcccaggccatgctcaggaacagctgtagtctgttggtacaggagcctctcgtgagtccaggcccgggcctccccctcctcagcctgcggcctgcctacccttgctgcttgaggaaggggcctgggcgggagcctggcagtagagcagtggggagccaacctgcatccagccggtctggcccgccaggaccagagacatcagcaggacgcccagctggatacaggcccccagaggaaggaggaggcgtttttgtgtttgagcccttgctgttccagaggcgtctcctgcctctgccttctaggcccttcctcaggcctctccccagggctcagcacagcagctcctcgcttcataaccttttgctcttgctcacattgttccccctcctggaaatggccttctagtctctgcatgtcgtacgtcctcctgtacagcccgcaaagacccaactcacacgtcctgtctccttttaaaatgtttcctgttcccagggcagaatgtattccgcttccctctggatgcccacagcctttgagcacaccctgcccctgctggagccctcaacctgtgggtgcactcttggcctgctgtcatttccggctctttagtatgggagccgcagcatggtgtggccgtgcagtcggggggttctccaggctgcacctgtgtgccattccacgcgctgcagacgtgactgggtgtcctcaggagctgggtatttagtgggtacaagtcctggggttcagcagaaatgatgcacagcactgcagtctgagttgggtgctgtggatgttggcagggaggaggtggcatttgatctgggatggggacggtaacagcggggtgctcgtttggacaggagcagggagttgaggtgtgggagagagagctgggcagcagcagctggaatggcagctcagggcagctccctcagggccttgcatgctgtgccaaggcctttgagctttatgttctgggcagggcaggcgtggaacctggggagcgacgtgctgagattggcattttggtaaggtgactcagggtgctctgtggcagatggatttggagggcaatggctgcaggcagggagaccaataccccagggaaagacagaaggagccctgcgctgagtggcagatggcttgtctggcagccactactggccctggagggaccagcccctggcctgggaacctgggaggctgggaggtgaggcaggactggagatggctgggtggagtgtgagggtcttgagcgagctcccaggaggaggctcttgtgggagggggcgcagatttgcctgactcaggtggaagctgggggcacttggggaactggggtcatctggccagagagggacgggtaggaggccaaagccacgcccctcagatgcttctacaggttgagtgtcccatatccaaaatgtctgggggccagaagtgtttcagatttcgatttcttcggattttggaatatatgcattatactggtcgagtgtccctaatctgaaaatccgaaatctcaaatgctccagtgagcatctcctttgagcgtcatatcggcgatcagaaagtttaggattttggagcatttcaggttttcagattagggatattcaacctgtagtacttctgtaaataccagaaaccgaatcctttgaaaaagctgccagggagcatacgatgacgttgtctgatttcaggttggcgagaattccttaggccttttgagggtcctacaggagaatcagatggatgggagttttcctgtgaatttcccattgcctttctttgtacgtgaccgcaccctgtcagccccatttagggccgccttttcatctcctcccagtagaacctggaagctgcacctagtgttggtccttggtgtgggttggggcagagctcatggagccccctggattgtggaggtcaaggccctgtggctttccttggggcctccaaggcctccagcattttctgttcctgctctgccctctgctgtgacggtgcggtgacttgagtgacagcccttactgagtctggctactggggcttctgcagcgtgggttttgagtgtgttcagggtttactgtgcccgcccttgcacagtgctgggtgagtgccctctgctcctccgagccttgtgctcagagatgttctcggcaaccccgctggcagagcccagcctgctggcctcccccttccttccccaaccccgcttgcgcagaacccacggttgtcttaataagtcacagaggtgggtggtgctgtggaggcagccaagcccagcccgatctctgttgcagttctggggcaagtgtggcctctccagggaacagccaccagccctttcccaccacacgagtcagcaggctcctagagtgatggcaatggtgaggtgtagccaggctctggcagcctggtggaaagcgactccttcttgtttatgaaaggctgctgtggtggcaggtgcctggggctcccgggtaagagcctgtggccccagcggccggagtgatgtttctgggcctcagtgtcataccgggcttgaggcatggggcttgggactggggatgcagtgcttgggctgtgctcccctgaaggaggagacccagtggagggctgagccgtgtgtcacctgtggtgcatgtctgggtgtcgtgggacttcctgccttccatgcgctgtgcatgtggatctggttttgcccaccagatggcttttaaggtgacatgcttctgagcggcccctgtgtgctgcagtcaagggcaagccttcaccgtgcccaaggtgatgagcctcgactgtgaccacagactctgttgcggcaggagcccccacatgactgaatgcaggcctcacaagccttttctgcagagggccgggtgggaagaaagttttccaccctggagcagttgatgccgacccaggcgaggccggggagggtgccaggagcccggggccagccctcaaaacccacccgctgcgccatttcgagaaagagccctgagtgctggcagcttccctctctgcctctgctgcagccatcttttttttttttttttttttttttggtcttgagaagaattttcatttcagtatccagattcatttctgtatccagatttccgaggtaaacttcctggaatattctttccctaataattaatggaaatgaaatccacgtgacacagaagtaaccactttaaagtgagccgctccgtgccgttgagcacgtgcacaggaattcacttcttccagcgcgtatagagggcccagggggattctctggctgtctccggcctgaccagctctgctgtttccctgcagggtctggccctcactgcaggacaggttcagctcactgaaaggggtcccaacagaggtgaagatccaaggtaggtggaatcttggtccattctgagcttgtccacagcctccttatggagtggtggtgcatgttccattggaccaacgttttcttttaggtggtgcatgttgtgtggatgttgctagagccttcttgaaccccacccttccctaggcatggcaggtgggagaactcctctcgcagggacctagagcacatcagtccctgcagcgctggtggccagagacagagatttttgccgatgccagcagtggttccgtctccctgtgtcagtggtgtgtgacacgctctctacaggtggcatttctaggggcacctgctgctctccagcggagcttgccttataacctcctttctatcatttcttggtagaaaccgtgcttaacctggtaatgaatgttggataaaggtgagcaaaactgcagtccccaagttggtggctaacttttcatcttcatggtgatctctctagaagttggtggaatgtcaaaggtcaaatttttcatgggcctgtgtctgttctggccactccagggtagataagctggaccctggagtcctgatccgtgccccagctggcattgccacatgagttatctggggccagttcttcctgtgctgaagtgggccagaagaaggaggtgttgttttagagcagccggtgggctggcctgggccacacagaggcactgcccttctccctggagctgccgtgtctggtacattccagattctctgacccacaccaacacatgtgtgacccgacccagcccagccttagccctgacaccgccattcccagcctgtttcctctcctgtcaagtggggatgaaacccagccttgcctacctcatgggaatatactgagtgtcaggcttgtcagagggcaggtgggagagaccaggaccagtagggtgtgaggatagttcaggaattcatccgacgaatggttaaggagcagccaccacatgcgaggcgctgttcctggtgctggggtgcagcagtgagttccactgccctcgtggcgcttgcgtgctagcggggagagacagggccagagggtgggagaattgttcatgcacctgccagcgagaagcactgggaacagccagctgagggctgagggtcctgcagggcttggggaaagggtggtgctgtcttgacataagatggcaggaggggcggaagccagcgcggcatgtgcggagaggaagagcatgcgcacagggccccaggtgggctgtgcctggcagcttggaggcacaagaaggaggctggtgtggctggagagcagggcagggcaaggagtgaggttgggaggggacgggccagatcaggccaggccatgtgggccccagaaggacgtgggctttgactccgaggaaggccgagttctgctcttggctgtaacgacacccctggcccactgtgctgggaacagggtgcccggggaagaggcagggagagcggtgtggggctcttgcagtgagtggtccaggtgaaagtttggagaggcagtgcaggaggcagcgctggccagatctggatttatagagttggctggactcgctgagaggaagagaggggtcagggaggacttgaggatgtggggttaagggcagtggtggaacaggcttgcctaggcatgcagttggcatttatatggtggttctggggttactgagtgcttccccacagactctctgcttacttcttgcaacaaaccctccagggttaggtggaggggcaggtctggcatcggccccaggctttctggctccaagttactcagaaaatgccctgggcaccctggcagatgtggctggatagtctgcagtgtgcacggcgccaggttccccatgcatgaaatggaacaaggtcttccacccccagggctgctggcagggtgatagcagatgatggcacgaaggtcctttaggacatggccagatgggagcggtgagtccatttgctttggccttgtgaggtcttggagagagtggcagacagtgcactgtagaggttcactgacccctgtccactcctcaggcagctgctggcttctgctcaaagccagagtgagtgaccccaaacctgggagagcattgggtacaattcctaattttcagacgaggaagctgatgcccagagaggggtggggccactcagcaagaggcagcgctggcacctgggtgcctgcctcctggcccaccctggtctcctatacccagtctagtctgtgggtgctgggcttcctgggtgtctgctgtcccctgctgtctgggcaggtgcctgccatgatgggctctttgtgtttcaacagaaatgacgaagctgggccacgagctgatgctgtgtgcgccagatgaccaggagctcctcaaggtaagagggcctctgtctgctctgcagacggcacgcacgctttctgccctgggcagggaacctcatggtgctggctgaggtgggaggattttcctcccctagtgcctttgaggttcctcaggccctggggccggctgggtgcccgggcaggctgcttctctaggcatccctggggccagaactgctgggattctcttgggtagaacctggttgtccctggggcgcaggggagagggcagccgtgcagggaggggcagatctctggcttctgatgaccagtgggatggaaagtgtcctgtccttggttgatgacttcattcttcattcatcccggcgcctggctcccaagcccttgtggcccgagagtttctcccgaggtccctcatctaccctgcggtaggtcaaagaaactccagcacccaccttctcgtttctaaattttgaaataattgttttcactcgatgattatgagtaatgctactataaacattcttgcatatgatttttgactgaacacgttttcttttttttatatctgaagagatttattcacgtgaccaatggcctatgacacagccccaggaggtcctgagaacatgtgcacaaggtggttgggctacagctggttttctacgatttagggagacataagacgtcagtgaatccatgtgagatgtacactggctggttgaacacgtgttttccatcctcttgggtgtatagctgggagtggaattgctgggtcacagggtcactctgtgcttaacttttcgaggagcccccaaactgttttccagtgcggcggcaccatcttccttttccagcagcagcgcgggagagctccagtttctcctcgtcctcgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccactttttaattgggtcacttgtccagtgaggttttttttttgttttgttttgttttttttcttaattagtagacttaataatttagggtagttttaggttcacagcaaaattgagcagaaagtacagagagtctccacaggccccctgccccacacatacacagcctctcccgccatggacacgacaccctgcacacgggggctcctttgtcacagtccatgaaccagcatggacacattgtcacccaaagtccatatccagtgagtcttctctcctgtggttgagagtccgtggttctccgtgtgccaagtagttctctcgacattttgcctattactttggctctgggaaaatgtattctccacacaatttatatttgtatacatatttgtgctttagcaggcacttgacctgcttaggtttaaggagcaagttcagccgcctcccgcctcttgcctgccgttccttccagcatcagctctgtttctgcagcctttgcatggctcttcgggtcccccctgtgtgtgcgccacccagtggtcagcctgggagactttgctgggctcaccaagatcagatccacttgtgcacaggtgggcctgagcccaggcattgtaaacagatttgtggggtcactttcttgagccgtttcctctccactgtcttttggatactttctagttccctggggctcccttttcctgtcctccagacataaaccacccacttccgtgatggtggtggcacggccagctccctgccagtctgcaggagaactcggaatcctggtgttcctccctgacccacctgctgacattcgcttctcagagcctgcgagcacctgccccatacattctgcccagccgtgggagcactgcgcttgctttatatttccacattggcattgtggcaaagtgcactttacgtaaaatctgccatgtcagtcatgaaaaacaatttcctaacaggccctgtgggagctcgctgctgcttttttttttttttaatttaaaaaattatggtaaaatacacatcacctaaattgtatcatgttcaccatttttaagtgtgcggtccaggggcataagcacattcacggttctgtgcagccatcaccaccatccagccgcagaacttgttcatcttcccaaactgatacttcgtcctcaatttttaagccgcgttaaagcgtacgatttagtggtcttcagtacattcacagtgttgtatgaccaccacctctatccagttccacaacattttcatcacccccaaaagaccctgaaccactgagtagccactccccattcccctcaggccttggcagccactgagttaccatctgtctgtatgtcattggagtggaatgctggaatgtgtggcctttggtgcctggcttcctcactgagcacaaggttttcaaggtttgtccatgttgcggcagcacttagcaggactgcattccttgttatggataaacaatcaaaggaattggagaattccattggtattattgagacctgggagttggaggagggaggaaggagatacagatttaagatcattaggtagggtcaacccttgtagtcctgagttttaattgggaatatcagcatgagcccccgggcttcaagcgatcctcccacctcagccctctgagtagctggggtcacaggcatgcgccaccacactcagctaatttttaaaatttttgtagagaggaggtcttgccatgttgcccaagctggtctcgaactcctgggctcaggcaatcctcccactttagcctcccaaagtgctgggatgacgggcatgagccattgtgcccgtcctccgcatatatttttacattaagggatatatatgtatttccttatcttgtgccctgaaaatgcctagaacaatatgacaccccggctgtaatgcaggcggaaacacagagagcagcagtcacccaagacttgggtcacgtccgagggactcaggagccaactagcaatagtcagagaggggccagtgggagcctcgtaagcataggggctgcagtagacaggcacccttcacgtatgcccaaatccaggtgttcatagtgatgttttataaagtcatcaatttgacactaaaaacataagcgacaaaagaaaaaacagatcaattggacttcattaaaatgaaacactttggtccaccaaaggacaccatgaagaaagtgaagaaacagaaaaacctacagaaaggcggtaaatagttgtaaatcacatgactgatgagggacttgtatcccgaatctattaacaacccttacaactcaataagaaagacagaaaacccagttcaaaaatggacaaagtgtccgaatagacgtttctccgaagaagatgaacaaatggccaagaagcacaagcaaagatggccagcatcacgggccattagaggaacacaaagcaaaatcatcatgagatgccacttcacacacactaggatggctagaatcaaaaaagaaaaggaggccgggcctggtggctcatgcctgtaatcccagcactttgggaggccgaggcaggaggatcgcttgagctcaggagtttaagaccagcccagacaacatcgtaagaccccgtctctacaaaaagtaaaaaattagccagacatgatggcacactgctgtagtcccagccacttgggaagctgaggcgggaggatcacatagagcccaggagttcaaggcttcagtgagctatgatggtaccattgcactccagcctgagcgacagagcaagaccctgttgtttaagaaaaaaaaggaaaatcccagtgttggccaggatgaggagagattggaacccttctgcattgctgtaggaatataaaatggtgcagctgttatggaaaagtctggcagttcctgaaagatgtcaacacagttaccccgtgacccagcagttccactcccagctgtccacccaggagaagtgaaaatatacatgcacacaaaatcctgtacctgagcgtccatagaagtgttattcttaatggcctgaaagtggaaagagcccaaatgtccatcagctggtgaatgtataaactaactagcaataaaaaggaaatcaactactcatctgcgctgggacacgcgtgatcctcgccagcctcatgcttggtagtgtatgattccattgctgtgcagcatgtagataggccaggtcagtgctgtggggacgtggcagcccgctgcccccagatcaccttggagcacatgactgtggtcagcaccaccgtgcaggcagtgagccctcccagtgccatcgcccctgtcctgggtgccctgagcttctcgcacctgtgctcctgaatctgcctcagttggatgtcatggtgatgcccaggctctatgctattggcagtgttgccaattttaccttatcattgcccccgcctgccacacacttttctgaggaatgcaccagaacggactggctcagccagctgctctggcagcttccccaagcccgccaaggagcatttgtgtgacaagttggcgctgaaggcacaggccacagtgaaagggccaaggcactcccggtggcatttcatgccatggagttgacccttttgacgtggttaggatgttcagagctcaagaagtaggcctggctgggggctttctggagcaggcgtagcctctcaggtcctggggctcctcagcgatcctcttcccttttctggaaggaggaaagagctgtgcttccggaagccttgagcttctggctgggtggctcccatgggtatctcactcacctttccggcgagtgggggactaattcagccccgcaggagctgctgctcctggagcctgggccttccgggctggaacgccagtcccctggctggaaagcaggccacctctcagccccatcctgtcggcttcatctgttcccagctgggacggcgatccttggaggagaacaggccttgtcctggaggtgtccctgtgggctgtgttctgtcatagcaggccctgctgtgtgctgcctgcccacccagcaagccatgctgtcggctgcacgacagacacatatgctcctgtatgtttctgcagtgctcagcccgttctggcgtgtggtcccagcatcattacagcccaaggcagggaccaggcagggagcacttgctagtccaagacattgctgggcaggcacagggtcgttgatgggccaggcccctcctttcccctggctcctggcatgggtggcatgtgggggcaggggcactggggacagctggccttggcctggcttagatggagccagtgaatgtctgtggtcttccttgcccagggctgtgcctgcgcccagaagcagctacacttcatggaccagttgctcgataccatccggagcctgaccattgggtgctccagttgctcgaggtaaaggtgtggatggcccaggtgggcagtattgacgggcttctcttggtcctagttctggagctggtaggggctggggtgtcactccccctctgatgctggctggggtgtgacaccccacttggggatctggctggccaatcaggggccgggcagcatacgggcaaggggcagctgtgtcccaagggtgctggctgttgcccaaggccccgggggtgagtatgaaggtgggatgtgggcctcagagcagacgggccaggcacagaggagggtgagcacctagggtgctccatgggtgggtaggtaggcgggcaaaaatggaggagccagggcagacaggtggggcaggattctgcgcggtggggcttgtcctggcctctgtgcctggccccgatgtgcttctggggccttccctgtggggctgagggcctgctgggcgagtgctctggcctgtgacggtgtggccctgggggctgcctttgcagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtggtacgtgctcctggaggcctcagtggcagcaccctggcctcctgtcccagccccaggctgcttggttctgttactgcagacacccctggcagcggtgagttgcaagtgttccctttctctccctgcagggccagtgcctctgccaagtccgaggaggaggagaagctggcggagcttgccaggcagctgcaggagagtgctgccaagttgcacgcgcttagaacggaggtgagggtgctagctcctgggagggggttgcttggaggcaaggccctgctttgtcacctccctcagcacgtgaggcttaggcgaggttgcctgtgcaccgggcctgacatgttctagaatactgtggtgctcagtccgcggggaggtgagaggtgggtcccgtggctgggggaagggatcagcctcaggtattgggtggtgcccacgcctgagcacattgccatgtgccttgccgcacgtggtcctcctggcagcccttggcctggcctctgtttgattgcggaggagaccggggcccacaggagagtgagtgagggggctgaggctgggagccagaaggtcttgctctggcctgagtcgctcggtacagctcccctgtgtccctgtttctgaaagctttcttcctcgccctgggtgtgcagtgtctgaggtgagggccggtggcagcctggctggtgggcagggcagcctcaagggactctgcctctggctttgcagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaagtaagggtgcccttcccctcccctctaaccgccccctcccctgttcactcagactgagagcttatatcctgcttgggctcaggggcctcagcagcccctgacaagggaccacagggcaggaccaggggctgggaggggctgggctgggctccctgctggccagtggcgtggcagggctctgggcccctcagtgggctggggaggtgctgcttctggtccttggacctgcccaccttagcaggcactagctaggcccagatccggtgtggggtcctgcgtgtcccagcctccaggtgctgttcctgtgttggccgcactgttgtcacgttacgctccaaaatagcaaggtccattcattcttgtggatgaccaagaactgtgccagacaggcagacaaatgcctgcctgtctgcccatgagcctgctcagacaggatgagaggaagtgggctcgtcaatgtttgcttgtttcgttgttccacatgtgagatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatggtgaggccacagccctctcctgtccatttttcttgggacatttattttccccccttgccaattgctggggctgggaggacacgcagtgctggctggcatgtccctaggcatcgagggttgccagagcgacatgagagtgtggcatccccactgggccaggaagaggggacttaggtccgagaactctgattggtgacttccccgctgggagttctgtccctcacccttggctgtctttcaggtgaatgccacctgatcagtgtgagtgggggtgggaagcaggagatgccgtcgctacgtgagaccagcggcatttagtgcctgctcgctccctccctccctccctccctccctccctccctccccagctgctgcaagtggtcatggcagttgctgacacctctgcgaaggccgtggagaccgtgaagaagcagcaaggcgagcagatctgctggggtggcagcagctccgtcatgagtctaggtacgtggctgcccacctggccctctgcctggggctgccccacgcacaggcttccttttctgtgctccactagccctggaggagcatttggggaccggccccttcttttgtttttcattttctaatgcatgttttccttcacttgaaaaaatgctttcagcggattatcaaatgaaaacgctcatcgtagaaaattgagataactcagtaatagaaaatgtgaagcaaatgataacaaatgcctgaatggaatagtatttgacaattaaaaatgtaacttgggccaggcgcggtggctcatgcctgtaatcccagcactttgggaagcagaggaggatgaaccactttgagcatagagatcagcctgggcaacatggcaaaaccacgtttctactaaaatacagaaactagctgggcatggtggcgtgcacctgcagtctcagctacttgggaggctgaggtgggaggatcacttgagcccatgagagggaagttgcagtgagctgaggtcacgccacagtactccagcctgggtgacagccagaccctgtcttaaaaaaaaaaaaaaaaaagttacttaaggaaaatgggaaaaggcttataatgagggccatcttctcagagttgatttttgcatatggagtgaggtggggatccagtttcctcgtatcctatatggatacacatttgtcgcagcaccattgactggaaatcactctttctctcattgatctgcaataccatcactcttggtaattattaagtatccatatgttatgtgtgggtttctgggttctcctctgttccattctattcctttttttttttgctatccctgcactaataccacgtttcagggggctagaaaataaacagcaaaataaacccaaagaaagaaggtaaagccagttttctacctcttctaatttattttttaaataacagctctactgaattcaagttcatataacataaaatttacccttttaaaagtgtacaatttcatggtctttaggatattcacagagttgtgtaaccatcctcttatcactatctgagtccagaacatttttatcacccccagaagaaaccccatatgattagcagccattccccatccctccctagcctcaactcctggcaaccactgtcatagagacgctgtctgtctctatggatttgcctgtgctggacatttcctataaatggaataacaatgtgtggccttttgtgactggtgtctttcactgagcataaagttttgtaagggttatccatgtagttcattccttttcatggttgaataatatttgattgtgtggatatcccacattttgttgtagttggtagatgtgggtttctactttttggctatgtacatcgtaagtcttttgtgtgaacgtatttttctttttctttttgagatggagtctcgctctgtcacccaggctggagtgcagtctcagctcactgcaacctccacctcctgggttgaagcaattctgcctcagcctcccgggtagctggggttacaggcactcaccaccacgcctgactaatttttgtatttttaagtacagatggggttttgccatgttggccgggctggtctcgaactgctgacctcaggtgatccacctgtctcggcctcccaaagtactgggattataggtatgagccaccgcgcccagcctctttaactctgttttttaaagttattttttaagtggttggctttagaattacagttagcatcctaactgaaaacagtctagtaccaaatgaatttcaatagtatacagaaactgcctcctattaaagcaaaatgtatttgtgggtacaccattttaattcccttgttggttctttaacacttcttttaaaagttatttttaagtggttgtccttagaattgcatttagcatcctaactgaaaacagtgtattaccaaactaatttcagttgtatacaaaaactttgcccattagaatgaagctgtattaaatgtgtacattggtacacatttttatatttatcgatgttgttacctttgttggagttctttatttcttcatgtggatttgtgttactgtctagtgtccttccatgccatcccggaggcctacccttagtatttcctgtagggaaggctcactagtgatgaactccctcattttttatgtgggaatgtcttcatttctccttcatctttgaaggatagttttgctgaatatagaattcttttgtactttgaatgtgtcatttcagtgtcctctggctgccaaagcttctgatgcgaagccagctggtatatgatgagtctcttcactttcttttcaaaattctgttggtccctggctttggacagtttgattataatctgtcttcgtgtgaatcactgtgaatttattccattgggagctttttgagctttgtaaatgtgtcgtcattcatgtttttcatcaacactcagccaggtagttgacagctctttctccttcacatcttgcttgctcagagcctcaaggtcagccagaggtgagagatcagggccttctcaggtctctctctctgggattttcacagcccggcacacacccatggtcttccagattcccaggactgtgccagagctttccagagcctttgtggacatctgattttccagcctctcctgagcttcttgtttagtctcttgtttgccccggctattatgcactgcctcaggcagcagcagctaaagcatttgctgtaaatgttttccactgttgcacccccaagtagtggtttcaggtccatagcctctgagccctagttttggagactgtctttggatgaaccctccagccagccgtctcctcggagagccaggcttctcactgctcttggcctcggcacataactaccccatgtataccaggcactgaggagcctcttcttgccaattgaactgcagcagaaccctccactttaaaatgtattatagcgtttatcctaatcaccagtcactatgactctcttcccagtttttataattgctgttagtaaactgcttataatctatgccatcattcttataatgatcattggtattcgcaacagtgtgccatctcacctgtgactgtggcaccataggactggtggcaggtcttgcctttcagaaaggccccttatcgcttcttggctaagatcaagtgtagtatctgttcttaccagaaaggcaccctttacatccaggccgtgtgaactgggcagtgcgttgtgtacagggaagtgtctcttcacccttgagccccggccactttgggggtctggagagacgccaggggagcaggcctacggcgggcatcggcctctctaggggctctcaactcagctcccatcagttcagcatcctgatgtggcttgagatgaattcttagtgtctggacacaccagagaaagggtcagcatcaaatccacgccaaaggccactcgggacagttctttatttgtcccgtttcccatctgaccccttgagggccgtggtctcgatggccctcctcccgctgtggaaggccgtgtttctgtgctgtttcacctcccagcgatctgcatgcccgcagccaggctctgttggaggtgcggcaccacctatgaagtgaggagcagccagtgtgccttctgggctcttgctgggggcatggcctcatgtgagttgggagggccttggcactgtggatcagcaccacacaccaggagtcgccccccaggcttcctgaaacctcactgccatgaaaacatcaatgtatttagaaaccgaagcaatgctgtcagtgcaagaatgggacaggagagttgagggtaccaacagtggagagatgccaccaaccccggcagtggtgacgggctcagcgggcggggaaggtggcagcctagaggacagcccaaggggcagcggggtgccagggacagggcagtggtgagcagatggaagcagagggcacaggtgaagcaggtctggagaggcccacctccccggcgagaccctagcctgttcttctgtgaagaaagtgatggaaatgaataagcaaaccagctcccaagctggtggcccggctcacacagagcctgagcggctcccagctcgtctcttgatgtggctgatgtggctggcggcagcccgggtgaaacctacctttttgcagcctctgagggtccatggggcaagagctgatccctgcctcgcctccatggaactcctccaaactgtcctccagagagagaccccacaggcaacggctccaccacagcagaccaggggcagtggcagctacccagatcctcttcccagcccctgtggctcgaaaagcagccccatgcaggagagaaggaagccctggatgagcaggaaatctgacctgaaggactttccgacaccactgaatacactcagtgcgacatccagacatgcttggacagctgtgaaaacccagccacaaagagactagaaacgaagtgaggctgggatctctaagaagagagaaaacagagagaaaaaccagcacaaagatcagcatcacacaggccccagccaggcacagggtctccagggcaggggacaggggagatgaagggcagggctccggaggaggtgggcacacagtacaagccaggtgagtgcaggcgccgagcacagggtagatggaacccacctcctgccatctggagtacaggggccaagggctggggccaaagcttcaagagagacagcctgtggcctcagaggagcagccaggatgccttacaagcactgagggccctgcacacccggccttgggctctggaccctgccaagccctgcaccaagagtgagggcagagcaggaaggccgggatggaggtctagacgatttgataagggcagatgccacacgagggacacagtccggagcctaggaagacagtctagagcagtgcgcattgcggcaggaagcccctctgctgggatgccactggaagctgatggcgagtggagagggtcctggggcgcaattccaggcgggctgagcacattccccagctcggtgtcaccccgaggcacaccccaggattcctgagcttcagagtcaccctcgggatgggcagaggatgacagattcagggttcacagcacttaatgtcaatgctaatgacttcaacatgtaaaaggcaaagtctagctgacagtggggccacggatggggagcggacaggcagggcaggtgaggggctgtgtcctcctctgtctgctgggggagggggatgatggccatggtctagggttggcaactgagaggcagatgtggtcatggcagataaggtcagcgcagccaccacggtcgccactgggccgggcagccaaggcttagggctgtctgtgtgattgggtttattgtgtgtgcagtgttctccatctggttaatactgaacgtgccactgaagtcaggacagcccctgcctcctcactgtgtgccatgtgctgcccctggggcttggggggcagggggcaggtgggcgggggcacagccgggtcaacagaccctggcctgggtctcggaactgtgctgcggtcggtgtgacccagcccagggctcccaagctgctggcctggtccccacagagcctgagcagctcccagctcggcagtgcctgtcccttccctgccatcctggtggtgcctggggctcaaggaggatcagctgaggacatgtgccttgagtggtgggcaggaggcacctcgcctcttgcgccaggctcgctttcctgttggtttcttttctatttatttatttgtttattttatttatttattttatatatatatatttttattatactttaagttctagggtacatgtgcacaacgtgcaggttagttacatatgtatacatgtgccacgttggtgtgctgcacccattaactcgtcatttacattaggtatatctcctaatgctatccctcctccctccccccaccccacaacaggccccagtgtgtgatgttccccttcctgtgtccaagtgttctcattgttcagttcccacctatgagtgagaacatgcggtgtttggttttttgtccttgcgatagtttgctgagaatgatggtttccagcttcatccatgtccctacaaaggacatgaactcatctttttttatgggccgcgtagtattccatggtgtatatgtgccatattttcttaatccagtctatcagtgttggacatttgggttggttccaagtctttgctattgtgaatagtgctgcaataaacatacgtgtgcatgtgtctgtatagcagcatgatttatagtcctttgggtatatacccagtaatgggatggctgggtcaaatggtatttctagttctagatccctgaggaatcgccacactgacttccacaatggtggaactagtttacactcccaccatccttttggtttcttttctttcctctgcagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaa

SEQ ID NO: 1227 - DNA, 23596 bp, mus musculus; identical to SEQ ID NO: 199

SEQ ID NO: 1228 - DNA, 89583 bp, mus musculus
tgctagcaccacccgagccaatggcggcggccgaggggcggagggggctggcaggaggggagggagcgctggctttagagccacagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttccaatttatagaggcagtgtcacacagtggttaatagcatgctccataatcagtctgcctgacttctttctattcagtcctgccactctgaagcggtacaactgtgatcataatactcaacccctttgcatttcagtttccatctgttatgatctccacattattatacttatctcacagggcttttgtgagcattaagtaaattactacatacaaagtgcttagggtagtgcaactgacatatttcagataactatatatatataaaatatatacatatatatgtatatatatacatatataaaatatatgtgtgtatatatatttacacatatatattttatacacatatatacaaaatatatatgtatatatacaaaatatatatgtataatatatataatacatgtatatatgtatatatatgtataatatatgtatattatacatgtatatatgtatatatatgtataatatatgtatattatacatgtatatatgtatatatacaaaatatatatgtataatatatataaaatatatattatacatatatgttatataatatatgtatatatacgtatataaagtatatattatacatatatgttatatataatataacattatatatatatatatatgttgtgtgtgtgagatggagtttcgctcttgttgcccaggctggagtgcaatggcgcaattttggctcaccgcaacctccgcctctgggttcaagccattctcctgcctcagcctcctgagtagctgggactacaggcatgcaccaccacacccggctaaatttttttattattatttctttacttttagtagagatggggtttctccatgttggtcaggctggtctcgaactccagacctcaggtgatctgcccgcctcggcctcccaaagtgctggggttacagatgtgagccaccgcgcccggctgacagtatatattatagtatacacaattcttctttttgcagtagggtcattttggttgtttgaaaagctgatattaaaaatgtaagataggctggtcatggtggctcacgcccagccctttgggaggcagaggcagcaagatcgctgaagaccaggagttaggtccagtctgggcaacaaaacgagaccctgtctctacaaaaaaattaaaaattaacccaacatggggttgcacccctttagtcccagctacttgagaggctgaggcaggaggatcacttgagcccaggagtacaaggcggcagtgagccaggatttgcaccactgaactccagcctgggtgaccctgtctgtctaagaaataagaatatatatatatacatttcctttgtgttctgtttacaagcagtgaagaaataatttcccatgtgtgtgttttgtttttgtttttgagatggagccttgctctgtcgcccaggctggagtgtagtggcgtgacctctgctcactgcatcctccacctcccagtttcaagcaattcttatgcctcagcctcccgagtagctgggactacaggtgctcaccaccgcacccagctaatttttgtatttttagtagagacagggtttcaccatgttggctaggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggctgaggttggaggatcccttgagcccaggagttcgaggctgcagtgattcgagctacgatttgggcctctgtactgcagcccaggcgagagttagaccctgtctctaaaaaataacaaaataaaaaataaaatgttaaagtctaaatctagattttaccaaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccacttttttttttttctttgagacagggtcttgctgtgcagtgattcaatcatggctcactaccgccatgacctcttgggctcaatcagtcctcccacttcagtctccaaagtagctaggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaaaaattaaaaaaaattgaaagagaaagcatgctacaatcctctgctcagagatacccaactactatgcacatattttggtctttttgggtttttttttttttaacggcatcttgctgtgttgtccaggatgaagtgcagtggcatgatctccgctcacttcaacctccgcctcccaggttcaggcaattctcctgccgcagtctcccgactagctgggactacaggtgtgtgccaccacgctgtgctaatttttgtatttttagtagagacggggttttcccatgttggccaggctgttttccaactcctgacctcagatgatccacctgccttggcctcccaaagtgtgggattacaggcgtgagccaccatgcctggccagggttttatttatttatttatttatttatttttcttttgagacggggtcttgctctgttgcccaggctggagtggaatggtgtgatcgtagctcactctaactttgaactcctgggctcaagctgtcctctttcctcagcctcctgggtaacctgtactacaggcacatgccaccatgcccggctaatttttttatcgtttttgtagagacagggtctcactatattgcccaggctggtctggaactcctggcctcaagcagtcctcctgcctcagcctcccaaagtgctgggattatagacatcagccaccacatcaggccttggccttttttatttttagtttttattttccatatgtgtagtttattatgatcaacatgataaaagtcatctagctgcattttttagagtacatgaaagagatgttatagtaagctttaaaatatttgtaaatatttacagccactttataaaaggaaatcagctctttttttttacatcagcctttttttaaatttttgtttcagtaaaatgattaacctttcagttcctgataccattgatgaaagagcaatcaacaagaagaaacttacacccttcatcattcaggtatgcattgttctcccctccctttaacatgaaattactgtttgaggacctgttctgcagacttcagcctctgcactctgtaggctcccaatcaatccttgtaaaaactgttgagtgtgggattgttatccagattatacagacagaactgggactcagaaaggtttctgagcttgcctgagattaatgttggaactgaggttcaaatcccattctaatttcaaagccccatgttcttttcatttcataatgtgttcaagcactacagagataagcagaagtatataagctcttaattaactggcgtgcttaagaaatggagcatttttttttctatcaagtgaatattagattattagcaaaattccctcagagaagagcacctcttgggatgtggacattgataacttctaaaactcttttgggcatatgcagtactgttggtctctcacccatttaggcatttttggaattataacactttactcacatggatatatttactgtggtactcagccttttcatttagtgccagcatacttcaaaaggtaccaaataaaaatacaaagttaacttctcatgagattctgcaaaaggcaatagcaataaggctgaaatttgtcttagctaggctttctaacacaaaactctggaatttgttttttgtgacacatatatggatgaaattaatacagggtattaatttcctcattgaatgttattttcagtgaagggagaaagtagactgctaaaaaatggaaaggtcaagaagcaagtgtgtaatttggctgtcttgcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaaggtaatggaacacagtcattctggcagttgtttattggttatttttttctagtcatgcagactttcgtgctctcacttaatggaggtgattaaatggtggtaactagaatgaacataaggtaatgctatagagttattcaggaaaatagcctaattacatgactctcttctttactagtaattcacatttgtctggcactttacaattcattttgcaataatgacacaaaagcacagagagattaaggagctttcctgaagtcctcaaacttgattatctatttttttctgttctgcctacacaacttctaccccgttgccaccctcagctccaccattttgcaccatcttcttttttggagacagggtctcactctgtcacccaggctggagcgcagtggcacaatcagcctggctaacatggtgaaaccccgtttctactaaaaatacaaaaaattagccaggcgaggtggcacgtgcctgtagtcccagcttctccggaggctgaggcaggagaattgcttgaacccggaaggcggaggttgcagtgagctgagattgtgccattgcactccagcctgggcgaaagagtgagactctgtctcaaaaaaaaaaaaaaaaaaagaaagaaagaaaaaaaaagagagaaaatgtaagattgcaaccgggtgtgttggaccatgcctgtaatcccagcactttgggaggccgagacaggtggatcacttgaggccaggagttggagaccaccctggctaacatggcggaaccccgtctctacaaacaatagaaaagttacctgggcgtggtggcatgtgcctgtagtcccagctagtcaggaggctgaggcaggagaatcgcttgaacctgggaggcagaggttgcagcgagccgagatcatggaggcagaggttgcagtgagccgagatcacgccactgcactccagcctggtcaatagtgcgagactctctcaaaagaaagaaaagaaaaagaaaatataaggatgaattatatttctgttaaaataggattgagccttcaagagttaattgattaattttacttaaatacaaataccaccgtgtttctagactactttaatcaaaaggttaagtaaaagattcccaaattgtaaacatctttcccccaaatccctgactttttttttttttttttttgagacggagtctcgctctgttgcccaggctggagtgcagtggtgcgatcttagctcactgcaagctccacctcccgggttcacgccattctcctgcctcagcctcccaagtagctgggactacaggcgcccgccaccacgcccggctaattttttgaatttttagtagagatggggtttcagcgtgttagccaggatggtcttgatctcctgacctcgtgatccgcccgcctcggcctcccaaagtgctgggattacaggcgtgagccactgcacccagacccaaatccttgactttagaagtgttaaataagaacaacttatacaaacatatgacataatgtgaagcttgcattaagcttaaaggccataacctcatttggtatttgaaatgtgaagaataacagagaaaagaataaattgtagtattatgttattatatctgttatatatttatcttttttagtagattatgagtatcttgaaactaggaactatgtcatagtagtttttgcacctctattacttaacagtgtcaaaagactgaatgaacttggcatgaccattattgtgtcatataataactgtgggatttttttttttttcttctagccttggctgctttactccgagatggtgagactttggaggaacttatgaaattgtctccagaagagcttctgcttagatgggcaaactttcatttggaaaactcgggctggcaaaaaattaacaactttagtgctgacatcaaggtaactgttgaaagaatcacaacattttggggggatataatagctggaagatttcatcccagcttaacagagagaaaatcctaacactgtatcaccaagccttgttgtctcttggccctgaaggtagattttagaagagtaatagagccagataaggtacattagcacctatgttttattttgtgggaaaaggtaaaaatattatgctaatttatcatattataatgctaatttgttatatcctgcctattggtaaacatggagtattaaagaataggacatgactattctattcttaactgcctttcccaagcctcagtgtacctgttagtaaacacacctagaagagataggaagggcctcatgatttcctcttcaccttttttatttggcttctctcctgtcattttatcctacctttagttgtgagttcctcgaggatagcaatgagctcttatttatgtctgtgtatcctacctcagcccctgctccagggccctcctactaaagccaacttaaaacatagtatgtggcatatacaagaccctcatatttcttgcattgaattgaatttttttttcactcactgtttatcatgagcagtgggggaaaactaacaatggaggaagacatttattacatgttgcctttggcttctcatgcagagggccaacattaccatagcaaacattgtgtggagttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccaggctggagtgcagtgctgctaacatggctcactgcagcctttacctcccaagctcaagcaatcttcccacttcagcctcccaagtagctgggactacaggtgcacaccaccaagcccgattgatttttttttctttttctgagatggagtctccctctgtcactcaggctggagtgcagtggcactatctcggctcactgcaacctccgcctcccaggttcaagagattcttctgcctcagcctcctgagtagctggaattacaggcatccaccaccacgcctggttaatttttgtatttttaggagagacagggtttcaccatcttggtcagactggtctcaaactcctgacctcatgatctgcccacctcggcttcccaaagtgctgggattacaggcatgagccactgtgcccggcctgatttttttattatttgtagagatggggtctcactgtgttgcccaggctggactcaagctcctgggctcaagtgatcctcccacctcggcctcctaaaatgctgggattacaggcatgagccatggtacctggccagccaggtatattttgcttcatgcactagatgcgttcctgaaaatcagcaagccaaccataaatggattttatgtagtgggatatattttaaatgtaaagagaaaatcttatttttgtaaatgaagcctgctttgaatttttttattttttattttttaaattattttttgtttatttttttttttgagatggagtcttgctctgtcgcccaggctggagtgcagtggcgccatctcggctcactgcaagctccacctcccaggttcacgccattctcctgcctcagcctcctgagtagctaggactacaggcacccgccaccatgcctggctaattttttttgtatttttagtagacatggggtttcaccgtgttagccaggatggtctcgatctcctgacctcgtgatctgcctacctcggcctcccaaagtgctgggattacaggcatgagtcaccgcccccggccatcaatatttttaaaaaggaaataattgtttggtaatgtgaaaactaacttccagtttatctgtattcaagttcaaattttcacctgtaaagcccttttcagggtagtaaatacagattttgctgggtctgctctttacttgttcttctcaagagcataggtttattataaattgtttgtgtagctttagcaagtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggcaccaagtttcaaactcacctgggtaactggtttaaaaggcacctttctgggcagctcccagacatttatatttggtagctcaggaattggattcagtaattcacatattgagtaacttcctcaggggttagtatgcacatagactatgagaaacactccttcatagcctgtctggaccttcaaagcccagtaacaggaaactattaatatcgtagctggaaggtggtcttcacatatggcaggattaaggaatcttgactcaaattccggtcctctagcattccaaagatgcaggaatttacttgacacgtgtgtaaaggttcttaataagcgtttgtgcaagtacaatagttttcaagctgtgttttgtggagttgtccacacaacctgaattcatgttgactgtgagccaaccccattgttttatgtattgggattctaagaaaacaacattcaagtgatttagtccaggggtttaaaacgaaaagagacctttgttttgttaagtacattcagatcatagagggttcagtgttattttagcaactaaaatgtttaccatttaatgcttttgtcatttaaatttacaattaaatacatctttaacatagctaatctcttcttcgtaggttgtggtatatgcattgtgctttgtaatgatataacctgtttattttctctttcttctatgcttcctggatttctgctctcctacttttttaaatgcttgttttgtctgtcaagcttattgacttcagtaattcagtgaaggtacagaactggttatatgtttattagcattattgtattgatgactttaataattgcgaagtcatgtcaaaatccagttcatccatatgcaagacagatataaggcagatagatggacttttctggggaaaacacctgttaaattaaaaggcagagatttgtgccatttattctcaaaaaatccaatgcaaatagccttccaaacatgggacaataggatacattcattccttgtaactgtgatctcactgacattttcaattctttgtaggattccaaagcctatttccatcttctcaatcaaatcgcaccaaaaggacaaaaggaaggtgaaccacggatagatattaacatgtcaggtttcaatgtaagtataagtgctcttttgaattctacaatcttgcaaaattattgtcaatttcttataagtacaataatttttataatcgtatgaagtagagttggcaattttaagcattattttaaaatgtattactgtacatgtaattcagaggccagaaaactagctttgatttattttgattgttagtgaattccatcgttgttgtggtattgatttatatggatggcataaaatattcaaaacaagtatggggaaataagtaactagaagctaaccttttccaagtatttggattacaaccacagtaatagatttagtgactatatgaaaaccttttccaagtatttggattataaccacagtaatagatttagtgactatatattcatattcctgtgttgagagtaatgtgattatgttttacaaactcccaatctatgaaatctaatttagggaattactctcagagaccatgttccctggttatgtcactaatttgtttagtgacattggacaagttccttctcaaaattggatttcactttgttcatccataaagtaaggagttagagtgaactatttagtcccaagtttctaggaatctgtggtttttgtacccattagatatggaatgcatgctactaattaacaaaatccacatatctagcctattatgccataggatggagtggattacattggctaaaccatttttcttctctttcttttttttttttttttttttgagacagagtctcactctgttgctgaggctggagtgcagtggcaccgtgtcggctcactgcaacctccatctcctgggttcaagcaattctcctgcctcagcctcccgagtagctgcgattacaggcgcccaccaccatgcccagctagttttatatttttagtagagatggggtttcaccatgttggccaggctggtcttgaactcctgacctcaggtgatccactcgcctcggcctcccaaagtgctgggattacaggtgtgagccaccgtgccttacgtggctaaaccatttttatgctgcccttatcagaactgaatttgtaactgacttgtgtgcttatatttctgtctgtatgttaaatgcaaaactcttcagctcaggtcactcttggtagggatgaggggccatcttgtccaagaagggagctgtctgggttggctagccatgtgatctgataccagggtaaatggcatcagtatgctaaccgattctgatacaccccttctctagtcaatcctttccaattgatcttaaaacactcttttgtctcttccctcttcagaatccgacaaggattcttctgttgactctagaattcagtctgaaatgttctgcttggcactcaccctacaaatcttgctctaaaatctagccagtgttatttccccaaaagtctgtgttccccaccccaaccttccttcccaccaccacccaggtgcctttgctcatgctgttctcatggttttcagtgtccttcatctttttcagctttacaccttctttagggtcttttttttttttttttttttttaagagacgaggtttcgccatgttggccaggctggtttcgaactcctgggctcaagcaatccttctgcctcggcctcccaaagtgctgggattacaggcgtgagccaccacgtccaaccaaggcctaattttaactctgaacagttttacctgttttttatttcaatttaacttttttctcttcgtctttgtaatggaaaaaatcccttcctttcgtcctaacttttttaatccttcaattccctgagattaatccttggtcttgccttccaccattctccctacgctcaaaagaaatcagtggaaatagattctctgcttctcttcaattcaagcaacagttcacaagcatttcccttgggatttgagcatgacatgaatgaaggtgtctgtcttctccctcagccagggaagcctacttccacagctcagcacaacttcctctctctctagctcgctctccagcagtgccctcctttctagttccttctgctgcataacacagccccagaggttccagggttccaaggagtccactctgtcatgaagctcattgacttaatgcacagtacccagaagcctcagtgaagttcagctgagagccagtagaaaaaaggagaaactccaaagcagaaagtagtaaatcagcaaaataaaataaaataagccaggttgaagagaatgaacccacaatttacagaaaatgaacaccattttctaaaggagacttaagtaggactacagttaataccctttcacatttaataattaattgagattcattgtagataaagtacatttgaaaaaaaattttaacataattctactgaaaatatctgaatatttaacttgaggtggcttaaaaggacaattgaagctgttttcctattgagaaggaaaaaaggaaaagtggaaccagagaaagtgaagatggtgaatgtatatttttctctacagattttcaaacaaaatctgggagtttcccccaaccttttacgtaacttctttcttaatgcaatttagttaaatgtactcagtagtttgctgtgtgatctggcgccatctagtgtatattacaggtactgcatctccaagagggccaacctttttttttgcattcaaaacaattttataataagtaccatatgttagctaaaagaaagtagaactgtatacccagactatgacagtggggaaattttctatatttttagtgtggcctttgacaaagtcttccgattttgtttcaacaggaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggtaactaaaaacctcaatttcgaatgtgtgggactatagagtagaaatacataggccacaatgattttacaatctagacttaataagtttttttatatctacaagaagtagatggcagatgctgagtaaaaactggcaggaaagtacgatacaagtgaacttttaaagtaaagtagtcgaggccgggcacggtggctcacagctgtaatcccagcactttgggaggccgacatgggcggatcacctgaggtcagtagtttgagaccagcctgaccaacatggtgaaaccccgtctctacgaaaaattaaaaaattagctggggcgtggtggcacatgcctgtaatcccagctactcgggaggctgaggcaggagaatcacttgaatctgggagacggaggttacagtgagccgagatcgcgctattgcactccagcctgggcaacagagtaagactccatctcaaaaaataaataaaaaaaataaaaagtagtcgagtcgcttaatgtaaagccacttagtaaatcagtatttagttttaatatttagggttagaccactttttaatcctctcatcaggaaaaagtgcacatatgcattcagtttgacctgtaaatttagcatatatttatgtttcattcatccacagtcaatgtaactggaactaaccccaactcctttcacctttacctcctcaagaaacaaatgataatatatactaatttttttttaagttttggaaaggcagagtttaccttttccagattatatatgtgtgaagcgtagtctataaaaattaagaaatgcagccaggcgcggtggctcacgactgtaatcccagcactttgggaggccaaggtggccagatcacctaaggtcaggagttcgagaccagcctggctaacatggtgaaaccccgtttccactaaaaatacaaaaaattaggcaggcattgtggtgcgcacctgtaatccagatactcgggaggctgaagcaggagaatcccttgaacctgggaggcagaggttgtagtgagctgagatcgtgccattgcactccagcttaggcaacaagagcaaacctccatctcaaaaataaataaataaataaataaataaataaataaataaataatgcaaatagtaattcattgagtgtccactgatatttctataaaaccagtaacttaactgataacatcagttactttgagggatgcagattcgaggaaatattggagaaagatttgagaaggagactataaaaagttcataaacctctaaattgcttaactggttagaataaggttgtattctttaattttaaaataaattcaaattttaaaaataagcctgtacctagagagaatgtatgtacttagaagaatgcttggaaactcgtattatcgaaaaattctagatctgaatagagagataaaataatctaatatgtgtattggcactatatgcacatacataaagtgtttaatgaatcagtaaattttgtgaatattcttaacaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaaaaaagaaaggtaaaaaagaaagaaacagagaccagggaatcctttaagtagaccatccacaacaactcagggactttggttcattgttctctcagcctggaacgttctttgctcgcatatagtggctcgtatccttactgtattccagtcactgattcaaagatttcctgactaccacctgctactctctaacccctaaccctagttcctttttttcttaatagcacttacatacacccctaaaattgtttgtttattgtcaacaaaccaataccccccgtattgtttgtttatccatgtacttgtttattgtctatctctctgactctaatgcaaggacagggatttttgtcctgtgggcccagcctctagaacagtgccttgcttacagtaagctctcaataaatacttataaatgaatgggatggtcttagctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagctgggcgtggtggtgggcacctgtagtcccagctactcaggaagctgaggcaggagaatggtgtgaacccgggaggcggagcttgcagtgagcaggagattgcgccactgcactccagcctgggcgacagagcgagactccgtctcaaaaaaaagaagaaaaatttaagaaatataaaaagtggaagataaagcatctttctgatgtttgcatttttcctcataaagtagatggtgacgttttcttctgctgcctctcttagatataccctcaatgtcctggaagatcttggagatggtcagaaagccaatgacgacatcattgtgaactgggtgaacagaacgttgagtgaagctggaaaatcaacttccattcagagttttaaggtcagaatccatatttgactattaaatattatgtttgctggataacatctatcatttgggaaggcaacttttggcttctttgtgagtgagaattagtgttgggctaatggcacaattctttacgaattcactgggctttgtttttggcacttgatataagtaagcacatgttaatttgtatgtatcaaaattctcagatttgttctcctttcacactaggacaagacgatcagctccagtttggcagttgtggatttaattgatgccatccagccaggctgtataaactatgaccttgtgaagagtggcaatctaacagaagatgacaagcacaataatgccaagtaagggagactgctaatagtatgaaaagaacgcagctttgtagctggacagatctgaattctaattcaggttctgccatttaagagtggtgtcaccttgggagaaacctcttggagcctcagattcctcatcaataaactgggggcaataatacttaccttagattttataaagattaaatttttaaaaattataagagcctagccttgtgcttggcctactaggtgcttagtcggttgttgcttcagtggattacagaaataatgtagcatgtattttaatgcaaatcaggtaaaactttacaaggaaaataagagcttagggtgttcatctgtctgtctcattctttttttaaaaaacgcattatccacttatgtctcttttactatacatagatcattcttactacatttattgaatttatcttcatcagttcccatattaacagaatgcttgctagccctccacagaagactatgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgt

SEQ ID NO: 1229 - DNA, 1535 bp, mus musculus; identical to SEQ ID NO: 200

SEQ ID NO: 1230 - DNA, 3911 bp, mus musculus; identical to SEQ ID NO: 1056

SEQ ID NO: 1231 - DNA, 35652 bp, mus musculus
tcgcggattggccggccgcgaggccgtcggttggctgtgtccctctccacggcgcacagagcatgcgcggggcgggagtgagcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaaggtatgtctggaccgctgggcgggtctagctaaccgacctggcccagggtggaggtggggtggcccccggatcctcctggggacccgaactgttgaggcggagccttttgagacgcgcgctcgcgctcttctcgcagtagggtgtgggagtcagctctggatgtttgaccagatttctaaaacctgaggagaccccgatgcctcttcttttgggcaaatgaccctccagtatggtctccttaaaagccagaggagccttaattaatcaagcccttcttgattcttttcagcttatcaagccctaagtctaggggatacagagatgagtaaaacaaggtccccgcccccaaattgtttgtaatctagtagtggaaacggatctgtaaagcaataattactaggtttgataagtgctgtaagaggtataatgtacgtgcagggcacagtgttggcataaaagagggaatggccaactacaagggtggtcagctaagggatggcgtggcaagaggagacatttgagctaggcgttgaaaaatgagtaaacattcaccagttggctaagggtggggggcgtggtaatgttgggatgagaatttaaattttttcttaaattgtggtaaagtacacataacataaattttatctttttgtgcagaaactgggttttatgaaaaataaagtttatcatcctaaccatttttaaatgtacagttcagtagtgttgactacattcatattgttgtgcagccgtccgtcatctccagaacttttctcatgtggcaaaactgaaactactcccattaaacaaactccccatttccccctcccttcagcccctagcaaccattattctgtctctgtgaattttactgctttaattttttttgagacagggtcttgctgtgtcgcccagactggaattcagtggcctgatcatagttcactgcagcctcgaactcctgggctcaagcagtcctcctgccccagcctccctagtagctgggacttaaggtgggtgccaccatgtccagccaatttattattttactattgttgttttatatatatttttagagacagggtctggctctgtcacccaggctggagtgcagtggcgcgatctctaactcagctcactgcaacttccatcccccggggctcatgcgatcctcccacctgtttccggagtagctgggaccacaggcgcacaccaccacacccagctattttttttttttctttttttgatacagtctcgctctgtcacccaggctggagtgcagtggcgcggtctgggctcacagcaagctccgccttccgggttcacgccattctcctgcctcagcctcccgagtagctgggactacaggcgcccgctaacacacccggctaattttttgtatttttggtagagacggggtttcaccgtgttagccgggatggtctcaatctcctgacctcgtgatccgcccgcctcggcctcccaaagtattttttttgtgtttttagtagagacagggtctcgccatgttgcccaggctggtctcaaactcctgagttcaagcaatcctcctgcctcggcctcccaaagtgttgagattacagacgtgggccaccatgccaggcctttcatttagatttttccaattgtttgccattatacttttgttgtaataggcagcctttgtgtgaatttttgtgcacttcgtaactgagtgtacactttggaattccgattgctgggtcttagggaatgtgtatttaaaattgccattcaagaaaaccatgccagattttaataaagtcaatagtgtgagtaagcatttatttatattctctcaggctggtgtgtgatgagctatatgagtcaattcaaaagttaagatacatagttttacttttgaagctaagacttgtagtattttcttctacagatacacttacatgagtgagcaaagatgtgtgtgcgtgtgtatacagtaagtcctcacttaacattgtccataggttcttggaaactgactttaagtgaaatgacgtagcaaaaccaatttttttctcatcagtgttgcagcaaaatgatattgaatgaaccagtgtcattcaagggcctgctgtgtgtcattttgcttaaagttgcagttgccaagaacctactgaccacgttaactgaggacttactgtacatataaacatataccagaggtgtgtgccatgaagcccggctaatttttaaaagatttttgtaggctgggtgcagtggctcatgcctgtaatcccagcactttgggagggcgaggcaggtgcatcacgaggtcaggagttcaagaccagtctggacaacatggtgaagccccgtctctactaaaaatacaaaaattagtcagatatggtggcgggcacctgtaatcccagctacttgggaggctgaggcagaattgcttcaacccaggaggcggaggttgcagcgagctgagatggcgccactgcactccagcctgggcaacagagcaagactccgtctcagaaaaaaaagaaaaaaaagatttttgtagagatgaagtctcactgtgttgcccaggctggtcttgaactcctagactcaagtgatcctcccaactcaggctgccaaagcactgggattacaggtgtgagccaccatgcccagcagaatcagactttttattacacttacattattacaccaccgttcaagcattctactctccatcttctaccttactccctctagaataccaattccaacaaatgtttgatattgttgggacctatagttcattgattccatcttttcactgttgcacacccctcaggttctcacttctctccttacatagtttgaagttcagagtcaataattgtggaggcttccttgtatacaactttaacttattttttttctctttcacacttaattatactggcttggcaagaccatagccttcgtatggtaagcagagtaatggcctcccgaggatatccacatactaatttctgaaccctgtgaatatgttaccctcatatggtagagaggaattaaggtcactaaccagctgaccctaaaatagggaaattggaatatctgggtgagcccagtgtaatcacagggtgcttaaaagtggaagaggggctgggtgtggtggctcacgcctgtaatcccagcacttggggaggccaaggtgggtggatcacctgaggtcaggagttcgagaccagcctggccaacgtgatgaaaccgtttctacaaaaatagaaaaataagctggacgtggtggtacacgcctgtaatcccagctacccaggaggctgaggcaggagaattgcttgaacccaggaggtggaggttgcagtgagctgagatcgcaccgttgcactccagcctaggctacaaaagtgaaactccatctccaaaaaaaaaaaaaaaaaaaaaagtggaagagggaggcagaagaggaggtcatagtgactcagtgtgagaaggattcaacctatcctacctggctcggtagatgggggaaggggctatgaaccaaggaatgtgtatggcctctggaagctggaaaagcaagaagcacattctccccctagagcctccagaaaggaacacagccttgctgcaaccttaattttagcccagtgagacctgtgtcagacttctaacctatataacctgcaagatataacctgtaagataaaagataatactttgtgttgttttaacatttgtgatgatttgtaacggcagcaataggaaactaatacattttgctaaatccaactctggccctctcagatgaacatggttgaagaaacaatcatgtgactggtcttacttgaaatccatcaatatcgatgtcaagcaggcccttcatgctgcctggcaatcatagtacatttctctaatgtattcactcatccattgtactagatgcctgtttcatgccttcttgcttttcagaccctcaacatctcaccctcatctctcttgcttccaatttcactgggttgatagaagcaatcagaagacagtttccagaagcttcttccatatcaacctacttcccagcattattccctctgtgttctttgccttctgtcctgttagtatggatgaactctccatgcttctagctaaggcacaacccctccatttgtgcaaaagatctcatcccttgtcactcactggtataaggacttcagcccaccaattctttcattgttaaaaaaaaaaatcctctcttgatcctattttcatttccagttattgctccatttcttctctttcctttacagcaaaattccaggtgtcatatcattgtctacacttgtcatttcctatttcttttctcctaacttctgttgaactcgtcccaatcaggttttcaccccatcactttacacaaactgcttttatcaaagtcaccaatgacattcatataactaaatccaacagtcaattctcaatcttcatctacctcgaccagtagtacttgacgaagttaatcacttctccatgaaacacatgattcattagtcttccaaggagcccttgctctccggattttcttcttacttcactgactgctgcttcagattctgttgatattcctcctcatatcttctaagataatttaaatccccagatatgacatttcacgctgaaatacttaagtatatattccttaaaaagaacatattcttttttttttttgagacggagtcttgctctgttgcccaggctggagtgcagtggcgcaatctcagctcactgcaacctctgcctcccaggttcaagtgattctctgcctcagcctcccaagtagctgggattacaggcacctgctaccacgccaggctaattattgtatttttagtatggggtttcaccatgttggccaggctggcctcaaactcctggcctcaggtgattcacctgcctcagcctcccaaagtgctgggattacaggcatgagcccccttgcccggtcaaaaaaaaaaccatattcttacaaaaccaccatgccatatcacacctaacaaaataaatgaattcattgatattatctaatacatagtccatattcaaattttttttttttgagacggagtcttgcagtgtcatccgggctggagtgtggtggcgcaatctcggctcactgtaaacttcgcctcctgggttcaagtgattctcctgcctcagcctcccgagtagctgggattacaggcacccaccaccatgcccagctaattttttgtatttttagtagagacagggtttcaccatgttggccaggctggtcctgaactcctgaccagtgattcgcctgcctcggcctcccaaagtgctgtgattacaggcgtgagctaccatgcccagcctcaaatttttgaatggtttatcaggatccaaagaaggtctacaacttcatttgggttttatgtttcttgaacttctaatctagaacagttctcccctcccctccacttttatttctatgacaatgatttgaattagtgtgatgtcttccttgtagtgtcattagtttgttctgtctcctataatttaaactaaaggcttgataagattaagcttcaatatttttggcatgaatactttatagggaaggctgtgtagctatattgtgtcatatcaggaagtatataacatctgactttcctactttcaataatgctattgaaaggttgatcaatgggttcagtgattacaatctgattcctcctttgcaaagttgcatttcccccttatgatgaggaagtaatacgttcaggatagcttagtattctgtgaatatccagttccccaccaacccatcaggctttcaaccattgataattattgctcaaatcagtttttttttttaaagagatggggtctccctatgttgcccaggctggtcttgaactcctagtctcaagcgatccacctgcctcagcctcccaaagtgtcaaatcagttattagagattacaaagtggtgattttcttttctgagacggagtttcgctcttgttgcccaagctggagtacaatgacgcgatctcagctcactgcaacctccacctcccgggttcaagtgattctcctgcctcagcctcctgagtagctgggattacaggtgggtgccaccacacccggctaattttttgtgtttttagtagaaacggggtttcgtcatgttagccaggctggtctccaactcttgacttcaggtgatctgcctgccttggcctccccaagtgctgggattacaggcgtgagccaccaagcctggctgcaaagtcgtgattttctagtttcaccgttctttgtgtattcattagctggaattctatagatgatcttaatgttggaatgccatgtcttttttttttttttttttttttgaggcaggtctggctatgttgcccaggctggtctcgaactcctgagcccaagtgatccacctgccttggcctcccaaagtgctgggattacaggcatgagccaccatgcccagctgtctttttttttttttttttttttttttaatactccttccttgggtgatcttatccaggttcttggctttaaatctcatctctgtgctgagaactttcacatttttttagtaaaccttttactttggcattattttattttatttttaaagtttttgggtttatttataattgacacataattatacatgtttatggagtacagttttatttctgtttttttagagacagggtctcgctctgtcatctaggctggagtgcagtggcgccatcatagttcaccgtaatcttgaactcctggactcaaacgatctttctgccttggcttccaaatgtgctgggattacaggcatgagccattgcacttgaccagttttatttttgaccaacaataattgtatatatttgtggggtacaatgtgatgtttcaatgcacgtatacattgtgaaatgatcaaatcaggctaattaacatatccatcacctcaaatacttatcatttctttgtggtgaaaaaatttaaaatccattcttcagcctgaccaacatggcgaaactctgtctctactaaaaatacaaaaattagttgtgtgtggtggtacgcatctgtagtcccagctactcgggaggcagaggcaggagaatcctatgaacccaggaggcggaggctgcagtaacctgagatcatggcacactgcactccaggctgggtgacagagggagaccctgtctcaaaaaaaaaaaagttcattcttttagctattttgaaatatatgattcattattattaataatagtcaccatgatgtgcagtagatcactagaacctattcctcctgtttaactgaaactttgtaccattgactaacatttctcctttccccatctacccctatccccccagcctctggtaactactgttctactctctacttcttttctagattccatgtataagcgagatcatggagtatttgtctctccgtgcctggtttatttcacctagcaaaatgtcttttaggttcattcatgttgcaaatcagaatttcctgccttttaacggctgaataatttttcattgtgtgtatataccacattttaaaaatccattcatcctgttgatggtgactttggttgtttccttttcttggctactatgaataatgctgcagtgaacacgggagtgcaggtatctcttcaatatactgatttcaggtcctttggaagtacccagaagtgagattgctggatcatatggtaactttatttttagttttttgaggaacctctgcactgttttccagaatggccatacttatgtatgtatttatttatttagagacagggtctccctctgtcacccaggctggagtgcagtggcacgatctcggctcactgaagcttggggctcctgagctcaagcagtcctcccacctcagccccccaagtagctgggatcacaggtgcacaccaccatgcctggctaattttttgtatttttggtagagatggggttttgccatgttgcccaggctggttttaaactcctgagctcaagcgatctgcccaccctaggcctcccaaagtgctgggattacaggcgtgaagcaccatgcccagcccagaatgtccatgctaatttataatagtaccaacagtatacaagcgttcccttttctccacatccttgccaacacttgtaagagttaaagaaagaggaaagaaacaaaatgcagctcaacagttaaaggcaggtttacttcagataaaacctgagaggggcttctggccgatttttggtcaggagtgctttctcttacagactaagagtatatattggttttagggtgagggggcttatcacaagcttggaatgtttctgtgtgagggagaggttttatggcagggttggaatgtctctgggaggagaggaggttatcttggggcagacatctttccagccaaggcgggttatctcaaggctgccatcttcctggccagaggggggttatcttggggctagcatgtctctggttggggaggagtttggaattgtgggatatgatgaggttgctcttcaaatagcctgatcaatcctttattcttaatttttttttttattttttttgagtcggagtcttgctctgtctcccagagcagagtgcagtggcgcaatctcggctcactgcaagctcctcctcccgggttcatgccattctcctgcctcagcctcccaagtagctgggactacaggcgcccaccaccacgcccagccaattttttgtatttttagtagagatgggatttcaccgtgttagccaggatggtctctatctcctgcctcggcctcccaaagtgctgggattacaggcgtgagccaccgtgcctggccaaggtcttggacttttataaggcttggggctgtgtcttctaatgagttctgtagttctgttgaaacagccttaaagtatgttatggaagtggctaatctgcttgctctcaatccaagtccagaggttatacccaaggtggctattaagggaatgacatggatggcccttccttttctaacatattggatgggtgggatgggcaaaggtcgatcaggaggaacaagtccaatggagggagatagataaactagggtacaggttccagtccagttggtagggagacaaaggtatgtgttggtgccacacaaaaagaacaggcctttgtcgtgtatacaggcagagatatggaaagacagtaggtgaactaaacatggggtgttttttctttcctgtggttcattactccaaatggacaaggaggaggccagggagacacctactatagtagaaatataggaagagttactttttacacatttaatgcaataggatgttgcaccattgatattgagccatggaaaaaggtgggcaccaggcacagcacaagttaggccataggcattggctgagagagaggctgtcaaacgagccagttgcggaaatgctccatttgcttcaggtgatactgggtagttaactcggttagtttgatggtcagaggggtgtttaataatgatagtacggttgcgttggttaggtgttaaggatcctacagggagatttccttcagaggctgaaaagcaaagtgaagcttgttgtaaaaggggggtgtgtttagttataggccctttaatgggagagtcttgaggcttgaggcgttgcagggagttgtaataggtttgaaataatttgttagcctgattggccctggaagtaggataattgccgaccagggtgtcagctctttcaagaaaggaagctcccttttggagtgtataaattagggttatgctccctgctaaaaggtcatgaagggatgcaggaagggctgtgtaggctgaggaagacagcgataagcacatccagcattcaggagcaaaggaagagttagttcgcagcaagagggattgtgtaaggtttatagttcgagcttgagagcagtgagaagtggttgtattggtgaggttgatgtacttagggtatttgtattgaaaaaaaaacaagcaaaaagcgaaaaaggttatttgggtaagagtaaagtcctggaaagttccttgaagccataggtcccatagaacagtaaagagctgatcaggatatataatgggagtttcgtaagggtaccgctgaaggactgtaacaaggttgattaggaagcagtgaaagtttgggagagaaagagacataagtggtttaggtgaatttctcttccttttcttccaagattcgggtgaggcaaagggaagtgggtcctgtggagacacaagagaaggctgaaggggttttggatttggttgtttgggtatgtggcaaagggaagtctgttttcttgagagaagtataatgaaaccagttggggagtccctggagttttgctgctgtgggtatggtaagaatgatttggtaaggtccctttgttagaaatgtttgttccctggtgccataaagaaatagcacttgaacataaaattaatttcctcagcaaggccatttttactttctgcagaaagagcaccctcgccagcagttttgccatgagagtacaccgaacaaaggagacagggtcatttataaactgacgcttccaccctactgctgtgtccagtttccattggctggaacgggacctcacattctgtatttgtcccgattggctagcaacttagaactttttaaaagaggcaaagacagaggagaacaaaggaaggaggaagtaacttgtggaatgctgagaaaggtaaaaacaccttcaaataaggaagaggaacaggctatgacctaatgtttgcttggactagtataagcatgccagggcaaatatttaggctaaattgtaggagctaagaacataaagtacattgatttctttattacggctggccgatatttaaggatgttagcacaggtctttgaataaattttgcttctaagagaagttactatttattcctaattaggtggggaggaaagtctttgaagaggaacctctactttactttttacaccttccatttaggtgtgaggggggaattgggggtaggactgggatcttttatgagaacccagtcttctggctataggaagggattagaggagtcagtgatgggttgtggcaggtatttgtcagcatattcccaaatgaaatggcggataatatacagaagaggggaaacaaggggagttggtagaggtggtgtttgaccctgaggtggaacaaaaggggccagtggtttcccatacatgagttcaaaggggctgagcattaagggtttatgtgggaatgcccaaatttttagaagggccaaaggcaaaagtgtaacccagtctttaagagtttggagtgagtacctggtgagggtggtttttagaatgccattcatttttccaacctttcctgaagattgaggtcgatagaggatatatagcttccaggtgatatgtagagctggtgcaagtgttgagtaatttgagagatgaattcaggaccattgtcggattgaaaagaaagaggcaccctgaacctgggtatgatttccattattaatttggaggtgacagtagaagcccatttgttggttgtgggaaaagcctcgacccatcctgaaaaggtattgatgagaactggaagaaaccgaacctttttaactgggggcatatgggtaaaatcaatttgccagtcctgtcctggaaggtgtcccctggcttgatgggttgggaaagaaagggatttagtgttggagtagggtgaagccttttggcaagtagaacattgatgggaaatggcctttagctgttcctttatatctggggttatgtgtatatgggagcttaagaaatgttgtcaaggggaatggctagtatggaagaggttgtgaatgtcctataaaagagcagtttcttcagggtcagatgggactaatttgttttgtacaaagcagtatgggggtttgacttgtgcccccgctgtgattagttgctgtatttggtgttctggataaaaggaggggatatgttgtatgaggcttaataggtattgggggattggatggttggttgaggcttgttttgcccaatactcagcctcacggtttcctattggaatgtggtttttatctgattgatgtcctttgcaatggataactgcaaccttttctggaagtaaagctgcctttagtaagtgatgagttttccattaatgataggaaatcccttagccgtgacatagccccgctcgctccaaatttgggcattggaatggatggtgttataggcatatttagaatcggtgtatatgttaacttgtgtactttttgctagggttagtgctcttattagggcaaataaatctgcttgttgggaggatatgcccaaaggcaagggggcagcctctacgactcttctaggtgggtatcatcatgatatccctcaatgatagcataccctgcttggagggaagggttttctgatgcactgccatctataaaccaatctggggcttgctttatgtgagtggaagtaagggggtagaacatggtgagagaactttcaattaaattcaagcatgagtgttggtcagtgtctaaaattggtcctgaaggcaaaagagtggcaggattaaggggggagcatctatgaagagagatagagtgttgaaggagaggtgaatgtaaggcctgcatgcaggaggatgagatggagcttagcgccttatggctgagtatattttgcagactgtgaaaagaaaatacctgaaggggtttgtagaatgtgagtttttgtgcctcagggataattagaggggctgtgaccaaaatttttaagcaaaggggccaacctttgtaaatggggtctagttgttttgaaaaatatgttaccagttggagggagtctcccatgggttgggctaatagtccaagggcctgattatgagaactgtgtaaatatagacgaaaggatctcagggggtttggaaggcctagagcaggggcctgtaataaggcacgtttttggtgagagaaagcatgataaagggctggagtgggagtgagtggttggtcaagattgccttttgtgtgttcataaaggggtttagtgataatggcaaaatttgctatccataatcagaaatatcccactaatccgaggaaagaaagtaagtccctttttgttttaggaaaagggatttgttgaatgctttgctttcatgctggcagaatttctcaagtatttggagttatcattaatcctaggtatgagacttttggagaggttaattgggccttctttttggacacctggtacctgcattcagacaaaaaatgtaaaagcctggtggtgtgttgaatacaatgttctagagaggggctgcaaagaagtaaatcatccatgtactgaagcaagatgctaggttgtagatgtagctgggagaggtctaattgaagtgcctgaccgaaatagtgagggctgtccctaaacccctgggggaggacagtccaggtaagttgttgggagtagcctatgtcagggtcggtctaagtgaaagcaaaaaggttttgagaggagggatgtagaggaatagtaaaaaaagcatctttgaggtccaatactgagaaatggctagtgttgggaggaatttgcaataggagggtgtaggggtttgggaacaataggataaacaggaacaacagtggagttgatttatcacaaatcctgaaccagtctataggagccatctggttttttgattgggagaataggagtattatggggagaatgggtggggattaaaatattggcagccaaaagtcagtagatgatgggcttgagtccctgtaatccattagggttgaggtgatattgtgggaccactgtgtagcgcttaggatcctttagtgagatttgaattagagaatggtgggtagctattatgggggagtcagtgttccatactataggatttacctggctgagggatttgggtgttttttgtttgtttgtttgttttgagacagagttttgctcttgttgcccaggctggagtacaatggcgtgatcttggcttgctgcaacctccacctcccggattcaagcaattctcttgcctcagcctccgagtagctgggattataggcatgcaccaccacgcccagttaattttgcatttttagtagagacagggtttctccatgttggtcaggctggtctcaagctcccaaactcaggtgatccgcctgcctcggcctcccaaagtgctgtgattacaggcgtgagccaggaatttgggttttaagtctatttgatgtggagtgtctgaggaggggtttttttcttgacataataataagtaagggtggctttgatgtagggccgatgaatgaatgattccccctagtttgtgtaggatgtcccttcctagtaaaggagtgggacaatgaggaatgaccaagaaagagtgagtgagagtgactccctgaaatgagcagtatagaggcagtgttttgtatggaagttcttgtatgtccttcatgccaacaacagaaaattatgaacattctagtgggccttgatattcagttaatactgataggctcgccccagtatccaggagaaaggaaataatcttactggataccgtcccaattaccctgggttccatggactcactggatgtgggggtgaaggattccaggcaccctcagtcttccgttgtcagtaccagcagtgaagatatttcctcctgtgatggtcagggggcctcacagggctacacttgaacagggagggtgtatccattgggcacagtccattttccagtgtccccaaagaccacaagttgggcacggtttggtagggggccaggggctaggacaagcctttgcccagtgtccagggttgccacattggaaccctgatgtggcacttcagggtgacacttccagagaggtgacggagtttcccttggggttgtctggaggcttttgtgtaactgacctttggacagcagaggtgagcatctggtattttaaccagacatgtttgtctttttgaattttttgttccttgtctctgttgttaaagacacggaaggccttccagcactttgggaggccaaggcgggtggatcacctgaggtcaggagtttgagaccagcctgaccaacatggcgaaaccccgtctctactaaaaatacaaaattagctgggtggggtggcgcatgcctgtaatcccagctactcgggaggctgaggcaggagaatcgcttgaacctgggaggcagaagttgcagtgagccaagatcacgccattgcactccagcctgggcaacaagagcaaaactgtctccaaaggccgcatttaggaggtcctgctgagatgtttggggaccttcctctaattttttttttttttttaagacagagtttcactctttttgcccaggctggagtgcaatggcgtgatctcagctcaccgcaacctccgcctcccaggttcaagtgattctcctgcttcagcctcccaagtagctgggattacaggcgcctgccaccatgcccggctaattttttttttgtatttttagtagagacggggtttcaccatgttggccagggtggtctcgatctcttgacctcgtgatccgcctgcctcggcctccaaaagtgctgggattacaggcgtgagccactgcacccggctgaccttcctctaatttttgtaatattttctggatatctggggcagattgggaaataaattggaagtggagaaaagtttgcccttctctagattctggatccagattggtatattttagcatggcttcagtgagatgtgataagaaaagggcaggattcaggccgggcgcagtggctcatgcctgtaatcccagcactttgggaggccgaggcgggtggatcacgaggtcaggagttcgagatcagcctgaccaacatgatgaaaccctgtctctactaaaaatacaaaaattagctgggcgtggtgacacgcgcctgtaatcccagctactcaggaggctgaggcaggagaatcgcttgaacctgggaggcggaggttgcagtgagctgagatcgcgctactgcgttccaacctgggcaacagagtgagactccatctaaaaaaaaaaaaaaaaaaaaaggctggattctcctggggctcctttgtaatttctctgagtttttcataattaactgccttatgggcatttttgttcatgcccgtgaggagacaggtaatcatgtggttctgtcgcctgatgccattgtttccctgttggtaagtccagtctgtgtctctatgggggactgcatcattggccactggattttatataggggcttggttatggagttcatctgcatgggcttcagctgaacaccagatgctctccttttcatcaggagtgagggtggaggttaaaattatataaatatcatgccaagttaaattaaaggattgggttacgtgcaggaattccctgcgatagtgatagggattgtcagagaaggatcctagctgccgtttgatttgtgacaaatcagacttggagaaagggatgtgaatacgagcaatgccttcaaccccagccacttcccggagagggagaatggctggggtggtttgactggtggcttttgaacgggtaacaggtggagaaggaggaggagtggggtttggggctggaggcttgagggcaggagggccccctggggtggagggtttggaaggatgaggagcagaaccagggggatgggaatacgaagggggttcatctgcagggtcaaaaggggtttcagaggaaggggtttcgagggaaggggttttggaggaagggttttcgcgggaagggatctcagaggaaaggtttttggaggagggagagacccagacagcattttcattgagaagaaggacttcatgaggggtgcaagcttgacatagggagggttgggagctaaggtagaagaaagcctgaatgtagagaacctcttgccatttgccattcctggttataaagttgtcgaggtccctaagaatttgcaagtaaaaggtgacattttccaaccatcggctgtcattatctaatgtgtattgcagccagaccatgttgcaataaaagactaaatgctttggctttatgcttcccggtaagccaagtttggtgaggttgtgaaggaggcagcccagtggggaggatgtaggaatgtgggattgtttggcacccatgtggactggtgagaagaagccgagggtgtctgtttttgttctaggcatccccagatgaaagacagagacccggcgtcctctttctaaagaggatggtcaagctgagatgaaaactgggcatccccaagatttcttctagctttttagtcctgctggtcctctgaggaccgggatggcagacctaacttttcctggtaccgtgagaaagccagaggagggcagatcttagcagttggctggattagtgtccaatgttggatgttccagttggaattggcaaagggccccttaaaccagagccacatgaggaagagagaaagagagaagggaggaggaggggagagggcaaaatacccattgtgggaagttggaggtggattcccaagatctgaaggtttaaagacttgttggggagtagccccggccagagccttgcagtccccttcaggttagttgtcctcatgcaaatcgctccaaaaatgaagtgagagaaaagacggggcaggtgaccagagaccctcaggatccaggaattaacttatgatgagctgccgttgcccactgcttcctgggttgcaagagagcctctgcccccagcacctgttccagatttcggcaccaaatataagagttaaagaaagagaaaagaaacacaaatgcttgacagttagaggcaggtttactttagataaaacctgagaggggtttctggccaattttggtcaggagtgctttctcttacagactaacagtatatattggttttagggtgagggggcttatcacaagcttagaatgtttctgtgtgagggagaagttttatggcggggttggaatctctctgggaggaggggaggttatcttggggcagacatctttctggccagaggggtgttatctcaaggctggcatcctcctggccagaggggggttatcttggggctagcatgtctctggtcagggaggagtttggaatgtttctggttggagatgttaattgtggtttatggtcatgctgaccttagccattaggctgatgccctttagatttaggtggttttttattaaggtgaactttagaatgtggggcttgtccaagatgccgatgctcccgctgaatgaggggcctgtccaagatgccgatgctcctgctctgtcaacacttatctttcatctttttgataatagaaagtctaacaggaatgaggtgatatttcaatgtggttttaatttgcatttctttgatgattattacattttttatctttagtcctgacctcttgaactccatactcctatatgtgattgcttggttgacatctctgcttgataatagacatatcagatttaacatgcctaaaaactaaaggacaaaaaacacatttcttacctcaataggtgcagaaaaaaacatttgacaaaatccagcaccttttcgtgatacaaaaacactcaacaaactaggaataaaaggtaacttccttaacctgatcaagggtatctacaaaaatcccatagctaacattgtacttaatggtgaaagactaaaggcttttcccgctcatatcaggaacaaggcaaggatgtttgtctgctcttgcgacttctcttcacattataattcaacattatagtggaggttcttttttttttttttttgagacggagtctcactgtgtcgccaggctggagtgcagtggcgcaaccttgactcgctgcaatctctgcctcccgggttcaagtgattctcctgcctcagcctcctgagtagctgggatgacaggcgtgcaccaccacgcccgctaatttttttgtatttttagtagaggcggggcttcttcatgttggtcaggctggtttcgaactcctgacctcaagtgatctgcccgccttggcctcccaaagtgctgggattacaggcatgagctatcacgcctagtctatttatttatattttttgaggcagagtctgttgtccaggctggagtgcaatggcgcaatctcggcttactgcaacctccatctcccaggttcaagcgattctcctgcctctgcctcctgagtagctgggatttcaggcgcaggccaccacgcccggctaatttttgtatttttagtagagatggggtttcaccatgttggccaggctggtctcaaactcctgacctcaggtgatcctcccgccttggcctcacaaagtactgggattacaggcatgagccaccgcacctggccttatttatttatttctgggacagggtctcattctgtttcccaggctggagtgcaatggcgcgatctctgctctctgcaacctccacctcctgggttcaagcgattctcctgcctcagtctcccaagtagctgggattacaggtgcccaccaccacacccagctaatttttgtatttttagtagggacggggtttcactgcgttggccaggcaggtctcgaactcctgacctcaggtggtccgcccacctcagcctcctaaagtgctgggatcacaggcgtgggccactgtgcccagccaaaacaattccatttacaatagcaacaaaaataaatgcttaggagtaaatttatacgaggaggtgcaacacttagatactgaaaactataaaacattgttgaaagaaatttaagaaggcctaaataaaagaaagatatcctgtgtttatggattgaaagatgtaatatctttaaaatggcaatacttcccaaagtgttctacagattctaatgccacatctaagaaaatctcagctggcttttttgtagaaattgatgagctaccagcccggccaacatggtgaaaccccgtctctagtaaaaatacagaaattagccaggtgagggtggtgcacgcctataatcccagctgctcgggaggttgaggcaggacagtcgcttgaacctgggaggcagaggttgcagtgaaccaagaccgtgccactgcactccagcctgggtgacagagcgagactcttgtttccaaaaaaaaaaaaaagagaaagaaattgacaaactattataaaagccatatagaaatacaggggacccagaatagccaaaacaatcttgaaaaagagtagtttagccgaccgtggtgcctcacatctgtaatcccagctactcaggtgactgagacaggaggatcacttaaggccagtttgagaccagcctgggcaacatggcaataccccatctctattattaattttttttttttttttgagacagagtctcgctctgtcgcccaggctggagtgcagtggtgcgatcttgactcactgcaagctccgcctcccaggttcccaccattctcctgcctcagcctcctgagtagctgggactacaggcgcccaccaccatgcccagctaattttttgtatttttagtagagacagggtttcaccgtgttagtcaggatggtctcgatctcctgacctcctgatccgcctgccttggccttccaaagtgctgggattacaggcatgagccaccgcgcccggcccccatctctattatttaaagaaaatttttaaaggaacaaagttagaggactcatagttcccaaattcaaaacttacgacaaagctacagtagtcaagacagtgtggtacttgcataagtatagatatagatcaatggaatagaagcaagagttctacactgttctttcctggaacagcatggagtgcccatatttcaggcacttgcttatgtgtagggaataatggttgctgttgtattttgttctttttgtgtttttttttatttttttttctgctcagtaagctttcatgtccaccttctggtaatggtcttatcccctggccactagggtgggcaagtaacattctttaaaacttttattgtgaaatataagatatgtatatttcacaatatatgcataaataaaatgtataaaacatgaatattcaatttaatggtggcctgggcctcttaggataggagcctacacaagttttggtttggggcttgacactgtcagctccgtactctatttcacctacaagagcaatcactgaaaaaagcgtaaggctttctgtaatatttattatctggttattggctttggattcctcagacaagaactatttggaccaaactatatggctcaaaagagacccaaggttcttcttgctcttttaggtcctttataccctgtcataaagagaatacaagcaggcaggaagagcaaagctgatttcaaagtgagtaaaagcaggcagggttgttgaactcctcctttgtaatcagacctgaacattttagtgctgcttttggttgaactgggcaaatacccttctgccagaataaacaggaaggaagcatcctcctacatgctaacaacatgccctcagaaagcagctgaacctgctggctaatcactccggaaaaaaacagcataacagtaattatgccaaaaccaaaattatccttttttctggcatagcagatgtgctttggcatctagagggtatcctaccagccaatgttcctcagcagaaagaagttttattatttttggggagcatttggtggctaacatcctgactgaccctttggaataaagtctaactaaaaatgaaaaattctccagggacagttaatttcttttacaatgggtatagacctttagtacctccagctccttaatcttctagcccaaggttatctggttaaccttgccaaacacaaaaggacaaatactttggggtttttacaatgggtatagacctttagtacctccagctccttaatcttctagcccaaggttatctggttaacctgccaaacacaaaaggacaaatactatatgattccacctatatgaaatatctagaataggcacatacacagagacaaacagtagattagatgtcactgaggggtgggagaaatggggagttatagcttaatgggtacagagtttctgtttggtatcatgagaaggatagtggtgatgattacacgttgtgaatgtaatcaatgccattgtacccttaaaatggttaaaatggcaattttatgttatatgtattttaccacatttttttaaaaaacctagacattctgtcacagttatggaaactagaagtctgaaatcaaggtgtcagcagggttggtttctttttggagactgagaaataatctgttccaagcctctctcctagtttatggtggtactggcaatcctaggagctttttggcttgtagatgcgtcactccattctctgcctccatcttcatgtggcattctcctctctatgtctcggtgtctcagtttacctcttataagtaaactagtcatatgaggttagggcctaccctaatccagtatgatctcatcttaaatcaataacatctgcaatgtcctggtcacattcacgggctccaggttgacatgaaattttggaggactctatttaacctagtacagggcactcccgtggataaaatcttctgggaaatgtacatagaatcagaaggacattgacaacaaaaagatccccagaaatgccaacattttataggggatatgtggatggagaggaattcaagatgcagactgagcatcttgaatggttagtgaggtagaagaaatctaggagaagggttgtatgccactgaacccaagcgggagggaaaacttcaggagggatgtagttatcagtggttttaagcacagcagaaaggtccagaaagataaagactaagaactgtccatggagtttggcaatatggaggttggtgtccttggtgagaacagttacattagagtgctaggtaagaagccaaatcgcagcgtgttatgaatcttgctttttgtatgccttcaaattgataggcagcagtctattggcaaagcagtctttttagtctctttcacctaccacctagattctgttattaacattttactatactcactttatcacatacctattcttgcatctattccatcaatccatcttctttttttaggatacatttcaaagtaaattgcagacatcagggtacttccccctaaacacttcagcatataaactattaagtggatttcaatatttgtttagtttttttcttttaaagtaaaattttcatacaaagaaatgcacaaatcttaagtgtacatttggtgaattttgacaagtgcatacacgtgtgtaacccaaacccctatcaggatatagaatactattatcaccccagaaagtgccctcacgccctttcccaggcattttccacctccagaggcaaccactgtcttgatgttttccaccatatgttagttttgcctattttagaacttgatataagtgaaatcacactgttgctactcttttatgcctggcttttcctcagcatgtttttgagattcatacatgtataaattcatacatgtagtagtttgttcttttctattattgagtcctttgtatgaatatatcacagattggtgggtttttttgtttgtttgtttgttttgagtcagagtcttgctttttcatccaggctggagtgcagtggcttgatcttggctcactgcaacctccatctcctgagttcaagcgattttcctgcctcagcctcctaagtagctaggattacaggaacccgtcaccacacctggctaatttttgtatttttagtagagatggtgttccaccatgatggcagggctaatctcgaactcctgacctcaagtgatctgcccacctcggcctcccaaagtgctaggattacaggtgtgagccaccgtgcctggcctaaacttttgttttgtttttttttttttttttgagatggagtctcactctgtcatccaggctggagtgctgtggcatgatctcggctcactgcaacttccgcctccctggttcacatgattctcctgcctttgcctccagagtagatgggattacaggtgcctgccaccatgcctggctaatttttgtatttttagtagagatgggtttcaccatgttggccaggctggtctcaaactcctgacttcaggtgatccaaccgcctcggcctcccaaagtgctggggttgtttccagtttttggctattaagagtaaagcaacattgtttgtttttttgactcttaaatgcctgtcttataaatggcgctaagcagggaaaagctaattattaaatattgtttgactgaaatgtgaaccacatttttccctaatttatgtcagaaatcactatttaataatattgtttgtgtttatatgtgattttaaaatgatccccaccttaattaaaatgaccatccctgaaagtgaagccaaaaggaaggaatcctcctagcctactctgccatgacttgggctttaaatggacctgttttcaatactggcattcaggtcacctgcaatttttatgttatccaaatgttttatgttttattgattttgatggagaatcaaaagacatctgttgtgtctaatgcatctacatgcatcttgacaaggggactggacatagagacatgtcagggagcagatactccaggagctggatcagtatagggaaactgttaacggacaggtctttgttctcagagctcccaagatagtggtgggccgctcccaagatggcagcaagccttttgttctctgacctggggttcttggcctcacggattccaaggaatggaaccttgggccacatggtgagtgttatagctctattagaagccgtgggtcatggaagagaaccgtggaacccagcaactagtgttcagctggattaggacgaacccgggcacttagccatgcaggaacaatggcgagcctttagcccgattgggagcggcaatgggcgccttgctatatcagaaacgcagcggacaccctgccatatctggaggggtggaagtcagcgatgggtctgcaacggtggcaaacagcagtggtggacggtgagcgaaagctcagctcgagccgtaacaaacacagaccagaagagtgtgcagttgcaagatttaatagagtgaaaacagagctcccatacaatgggagggacccagacgaggttgcccctcccggctcgaatgcctggatttatatcccgatcattttccctccccctgtgctctcgggcgatatatgatttgactatttctttacctcctgcttttagcctaatttgtatttcagtgagccctctttactacctgattggttgggtgtgagctgagttataagccctgtatttaaaggtaggtgtagtcaccttccccagctaggcttaggaattcttagtcagcctaggaaatccagcaagtcctgtctctcaaaactgggttcttgttgagaggacagcaataaccccactcacatgcgccgagattagcaggtctaggctcctccacccctatatgggcctagtggctggtggccagattacaaaacaaagagcatttctgattgttttgcatgtgaagaaaacaaagttttattgagttagggtctttgcattcagttctctgtctcttcacattcttttttttttgagacagggtctggctctgtagcccaggctggagtgcagtggtgacacgatcatagctcaatgcaacccctgcctcccaggctcaagccatccctcccaccttagcctcccagtagctgggtctaggcgcatgccaccaaacccggctaattttttttctattttttgtagagaccagggcttcactatgttgcccaggctagtctcaaactcctgggctcaagcaatctgcccgccttggcctcccaaagtactgggattagaggctcaagccaccgctcccagctgtctcttcacattctaaaataactttgtagggaatgttctaaagggccctccatagcaaggaaaatcaagtgtgtgtcttctgcaacttaagcttgtgtgccttttcagctgctcatttgtaaacactgtgtgtttaacttagcttagctctttggggcataggtctaatagtatggcttatgggtttctccagatagaaaaacttttcagcatctgaactggcagaccctctgtggagaagaaaggtttctcaaggtatcagccagttccaaagggaggtggattagatgttgagaggttaattggctatggtcaaggaaaatgtttgcatctgaggaaatagctttggggcagagatgattttattattattattattattttttttgagatggggtctcgctgtggtgcacggttggagtgtagtggtgcgatcttggctcactgcaacccccgcctttcacgtgattctcatgcctcagcctcccgagtagctgggattacaggcacccaccaccatgcccggctaatttttttgtatttttagtagagacggggtttcaccatgttggccaggctggtcctgaactcctgacttcaggtgattcaaccgcctcagcctcccaaagtgctgggattacaggcatgagccaccatgcccagccacagagatgattttatatggccacttgggcagggcttcttatagagagacctttaggtggggttatgacccagggggttagcaactgggcagttttgccagcgaaagtgtagctttccaggtaacaggactttgtagcccaagtttaattgttgtatcaccttcctccaggagttgtttgtatataatatttctttttttttttatttttgaaacgggtcttgctctgtcacccaggctgtagtgcagtggtgcgatcatggctcactgcagcctagacctcccatgctgaagcgaacttcttgcctcagcctcctgaatagctgggactgactacaggtgtgtgccactgatatggtttggctgtgaccccacccataatctcatcttgaattgtaatccagattgtaatcctcaatctcatcttgaattgtaatccagactgtaatcctcacgtgtttggggagacaccttgtgggaggtgattagatgtcctttaaaataatccttaaagagaaacatgctctagtcatataatttcaggtaaaaccatttaaacataaaatttttgtttttattgtccattcctatggaattaaaaactgacatttcaccccatactctagcactattcttctccttgttctcttgcttgagggttatggttctttgtcctgaactggttactcctccctgtcctcttggctcccaagcaggcctggcttctccctgcctatgttcaaggaaaataggggagcaattctggaaaaatacttgagcccatgaagtgttagctaagttatccagatcattagggatcctgtgtgctatagatggataaatcattacattagcaataaaaaggacatgttttccctccaagccctgaaaaatggaagtgattagaagttaagtggctaaatcaaactgcattgtaaaaagcattctagtcttgcaaataatcagatatccagggcagtgctattaaaagcatttatttttcctcctgattccattgtagggaaagaataccatcctaggtccaacttaattggtggaatagactgaggggaaaggaagagctgagatgcagttgttagacagacctgctaactagggtggaccagggactggggaaggcagcttggctcacagcagcggtttaacccagccagaaagcagtgatatccaaggaatactgtaaactctcgttgtggttcaggcagaggttgacaaatgggggttccagagggtgggtagagcacagcaataagtattttaggctggtgctaagaagtctaggcacacagttgccatttaaaaggctggcgtgtgtgattagtggggactctggcccagagctaaggatcagggacagcactttagtctctgggaaagacgcctggctagagttacacagaaccccaggtttcataggggtttcaggatactgggtaggttaccagttcaggaacttggaaataatctaataatttaagaatgttattttttccttcaagctctagaacatagatcaagaccgctttccaaagcagctctgaacccttaataattcccatcaatagtgggagtttttcacaccttgccaacacttggtattttcccacttgttggttatagccatcctaatgggaagtggtatctccttgtggttttggtttgcatttccctgacaactaatgatgttgagagtcttttcatgtgcccatctgtatatcttttttccatttatttatttatttatttatttatttatttatttatttattttttaagagacagtctcgctatgttattcaggctagtcttaaactcctgacctcaagcgatcctcctgccttggcctcccaaaagtgctgggatcacagtcatgagccaccgcacccggccctgtatatctcttccccccctctggttgcttgtgtgttcggcatcatatttaagatattgccaaatccaagtcatgaagatttttacacctatattttttcctaagttttgtaggtttagcccttagatttagatctatgatccattttgagttaatttttgtgtatggtatgagtaggggtccaatttcattcttttgcacatggatatccagttgaaaagacttcttccccagtgaattattttggcgcccttactgaaagtaattgaccataaaccactgaagaattttaagcagaggagtgacatgatttcttttatgctttaagacagtattgctggctgctatatagagtgtgtattggaggggcaagagtttatgtagggagagcagtttatgtaggaagctgcagttatccaggccagagatgatggtgacttgggccacagtaatggtagtagagatggaaagaaggtggttataacttgggaaataaagttagtaggacttgggactgcctggcctgggggtggggcataaaaagaaaggacaaggatgactcctatttaggttggggtcaaggattctcttcagatttgaagtttgggtggctaaatagatggtagtgttatttagtaccatacaaatggagaagcacgtttttagaggggaaataatgagtctagtttgggatgaattgaatttgatttcaagtggagatgtccagaaggcagctggaatatgggtctagagtagagcttgagggacagctctaggttggagagagtgatttgagagtcatgagcacataggtgggagcggaagctctgggaaaacttgaggagagattaaaaagagtgagaagaggtcctaggactgagtcctctgggaggaagaacacagaagaaatggtcagtgaagaggaggaaaaccagaaggaatctataggaatctcgtgaaaggagggaattttaagaggggaggggagtgatcaatactgttaaatggaggtccagtaaaataaggccagagaggttcccatgtttccatgcccctacacatagaggtttgttttacaaaaaatatcacttcatacttcttatgggtgccaattaaaaaaaaaatactgtggaaccaataacctttgcacattcattttccacaactagtgcctgaaggtgttgctggcagcatctggtggatatttgtttgtgtctcaagtgacgccagctttcattggcatcttgtgtgctaatctttcccatcctgaattgaggatattaaaagtccagctgcagtttggattctaaaatgaactctaaagcattcttagactgaatgttcaatgtttcctttctcctcttcttctttttttttctatagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgttttccatccactttgtttcactgagatgatactggcagatcttaagatatgcttgtgaacatgctgtttcatgctttcagcttaatacaggttgagcatccctaatccaatccaaaatggggaaaatttctgagtgctgacatgatgccacaagtgaggaaagttccatacctgatgtcatgtgacatgtcacagtcaaaatgaaggtgtataacacactgtttactcagcatccccaagagaaaagagattctgttagaccccttcagctactatatatcctttccacacaggcccagattctcccatgcaagcctgcctacaaagggtaataaaatggttcaacatacacaaactttgtttcatgcacaaaatcgttaaaagtaattataaaattaccttcagactatgtatataatgtgtgtatgaaacataaatggatttcatgtttagacttggatcccatctccaaaatatctcattatgtgtatggaaattctccacaatcaagaacacttctggtccccagcattttggatagagtactaaactggaacagcagaaagctgagctaggtacctggtgctaggattctttatcactggtagcttgccctggagtcactgctgaccatttagccattcttaatgcaccattaactgtgttctccctttcaccaaaccaggtatctcgtctattctgacacatattatcacagtctatctttggattgtagactgaaaaggagtttggttcccttgcagaaagataaactgcagtatagcacgctgcactctgtcaccagagaagtggactatccttgatgacgtactatgtgttgggcactccacacaggtttctcatttcagccttaccataatcttttgaggtgaagggagaatagcatttccatttttcatgtgaggaaacaggctcagtgatcagtgaggccgtgacttccctgtggtgacatggttggggtgaaaccgatttttaaccttgtgtaaatgaatacactataatacactgagctgtttttactcaaaacacttctgacaccaaatgtgggggttttccacatcaagcagttctccagttctccaattcaaaattgaactggtgtcctacgattctgtttcgacactacccagggttagcatcagactccacaagtttaagggctcagtcccaccagactgccctcacttcagacgtcagtggca

SEQ ID NO: 1232 - DNA, 35652 bp, mus musculus; identical to SEQ ID NO: 1231

SEQ ID NO: 1233 - DNA, 135457 bp, mus musculus
cgctcgcgtctcccgcaaggtggaggcggcgcagcggtcgttgacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccacatttcagactcgaaaggcttcagccaccgcttaccccttattcaagatagtatttgcaaagggcacaaagtttcagttataagatgagtaagttctggggatctgatgtacagcagcatggtgactgtagttaatcatactgtactgtatacttgaaatttactaagagagtagatcttaagtattctcaccacaccaaaaaaaaaggtagctgtgaggtaatagatgtgttaataaacgtcattttggtaattttccaatgaatacataaatcatcatgttgtactccctaaatatacacaatttttaatgtgttgaatatagctcagtaaagcttgggaaggtgggaagatagcatttgcctgcaataggtcagaagaagaggaggttataaaactcaagagtggagaagtagaagaaagaccaaagtccctaaaaaacccatttggaagattctgtttcctgatgttaacacctatggttaccttcctgccctctttttcttgaccttgcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcaggtactcaaaataaaaatacaaagagatctggagctatgtgtgattgggggttgggggcagagtggggactgaaggaagtgaaacccaccaaaagctaagagaactgtattttgcctttccctctttcatcatctttctgaaattatattccagaaagctttcctgtattgtactgaagtggtattcttgcagtggaaacttgaaacttgctgatttgagggagagggaacagtctgttctgttacagtggaaaatcctatcctgggatctttcctaaaatgcatgactctctaagttaatctatcttgtagtcaccactgtatttattctcattgagaaaatgtttgggagcaggtatctactattttatttcatttttaaaaattgtggtgtttgtatgagggtaaatgacatgaatcagcaaaccttctggactagacacagtaaagactttatctgttgatttttatagctgtggccactgtttcagagcctgttgcttcctccctcccccaactcctgggcaaaatgaggtcagagtcagcagatgcctttaagccaacttttaaggcacttcccctcagtaaaccagcatcctttatagaactgttgagacgcaaaggtagctgcatcctcttcaacgaccaagaaaataatattaagaaaacaatattctgggctatggtgggagttgaagtactctgttgtcagttataagatgcatgtgcattcatttccattagtgggaaaaattctctctataccagccattttctccagtggtctctccaagacttaggcaatctgagctccagtcttcatctataaatcagaatattgatatttggttattttacgagtatcaatataatgtggggttgcactgtgttgtccttagcaacagcaggcatttgttgttctttcaagccattattgagagatacataggtccaccaaaaaaaaaaaaattattcaagtttttgctccacaccaggtagtacagatcattatttttatgactttttttgttgttgttgagacggagtctcactctgtccccaggctggagtgcagtggcacgatctcagctcactgcaacctccacctcctgtgttcaagcgattctcctgcctcagcctcccgagtagctgggactacatgcgcgtgccaccacgcctggctaattttttgtatttttagtagagacggggtttcaccatgttagccaggatggtctcaatctcctgaccttgtgatctgcccgcctcggcctcccaaagcgctaggattacaggcgtgagccaccgcgcccagccttttatgacttttataaaaataccattgtagaaatttggaaaatatagaagagtgtttaaaaaaattcacctgtaatcctgcccactcccctcccccaaatcctacatcctactcaacgttttctagtttgagctcagtgttttgtttgttgctatttttactagaaattaatatcagtagaattggaatttcatatctggtacaatttgaccaattttttcaattctattagaagaaatctgttatctccctgtaatgttaacactttttcttatttggcccagttataaagaatttaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaataaaaaataaaaataaaaataaaaaaaaaaataaaaaaataaaaaataaagaatttaacagaggaagggggaatagtagggaaacattgaattgcccattctaaaattttaatattccattaaataatttttcacatagccaaaaaatacctttcataccaccttaatagtaattaggaatgtttcaaaacattatagcaatgggaaacatctttcaaaaagaaaagattttgtgggaatttttaaatttatatgaactttccttattaattgcaacaggtttttattattaggtctcaatttttttctcaaacctgattcagtgttaatcaaggaccagaaaatcatatctttttttgtcattagggttgtaggtcacatgtggtctctatctaactactcagctctgtgattgtggtgcaaatgcagccagagacaatgcagtcatccctcagtatatgtgcaggatggattccagtacaggctgcttataaccaaatctctgcatactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacaccagtctgttgattcatataatttctcttgaatctatcccctcttttctcttcccttctgcctcaaccttagtctaagcccttatttcctaacacttctgtgaaaaccacatttaaattatgttatttccatcctcgacaatctttctgtggccctcatttctccacaagtaaagtcgaaacattttggattgatagacaaggccctctatgggttggtcccagcttatttttttcaatattatatcacgctggtgccctccattatacccccagttccagccaggctgatgtctttattactcctctaatcccttaataaaaatacctaacatttgtataaatactttccattgtacaacacacttccccataattaccagtattttattctcacaataccctgtgaatcaagtattatcctcaatttccaagtgaagggactgaggcccagagatgaagctggaatttgatggtaccatgaatgcaacctgggtcttatgacttcggaatcagtattgtttgaatttttgcctccgtgggagccatagacattgccacctgcaaaaatttttatgggcttcttcttctacctgcctattccctttcaatctaaactaatatcctttgaaagcctagcaccaatcccactttttctgtggtccctgtccttcctcacagaccactcacttgtacagtgatcacttctttctcaggactcctttcttggaacttctagatcacttaccatctgtgccattcaacatcttcatttttttaaatttaaaagactgtgtaatcatcatgtgccaggccctataatagatgttaaaaagaaaatggtacaaaatgtttatatgtaaccctcaacttttttttatggaaaatttcaaacttacaggaaagttgcaagaatagtaaaataaacatatttgcatatactctatctaaattcgctagttgttaacactttgtcatatttgcgtacccacccctccacacacacacacacacacacacacacacacacacacgattttttgataagccttttgagagttacttgcagacatgagtttgttttttaattcaacttccttcgtccattgacttgaaggtctttttctgaacctggcctctgcccctttttctcagggagttcattgtctgatgggggagacagatatataagcaagtagttacagtacattaagataggtactataggtactgatttatatatttgagataactactaagctctgtgggaacacacagaggtgggaatgtctaaacttctttgggacgaggcaaggaagacttcagagaggagttgggttttaaaggataattaggaaatgctgggtagactatgctgtagttagtttttaaaacatatctgtcccatttcccttttctttatgttctacaaaacctgatagaggttcaataaatatctgattgcacatatacctgggggtagagagaaagaggtacacagatatggttgtgtagttatatattcttataaagtcagttcacagatatatattgatttatgtcgtcaaaaagaataggcaagagggagagtcacttggtatggggtagaagccctgatgtatgaatgtacatgtataattaatgccatctagcacacctggatcagaaaacagttagtttggggaacacagagtacagatacctcccatcattcctacctcccgatacttcctactaattttatcttgccttggaaattagaacttgaggatagaaatggctgacaatggccactaattgagatcctccactgagtccttgattccccagatttgctgtttaaagaaaatttagatgggagtagtggggctagagggtaaagggagttgatgggtttgcaagagaaaagatgactaaggcagtaaaatagtgaagaagccaatgacatgagcccaggattcttacagaatagtataaatgctgagttctatattggtcgactagaggcccttaatatgtttttttaaaatgagttcctttaggccattgatataaagacaagactattcaagcccctccctctgcttcccattctaattcattgacttttagaaaagacagaatatggtagaaacctttgagtatgtggtgacatgtatcagaattgaataaagtttccccacagaagaggttgtgttaaatactttccataacaggtatattaaagagatggactctttcattagcatcaaagtcatatagatgtcttcttgtaggggttacagtaagtttccttgctttataataaatgtttcaggctttaaaatgtgacaagatcatgcactgcctattctttctctctttttaaaatttcttcttttgatctgtaaggggaggggaccatttatagacagaaatgacttaagaaaggggactctcccacagaaaccatttttattcttatttttccctcaataaaaggcttcataaagagttggaacttaataggtacttatccttatcatgactattgcttgtagtcccatttgaatatgttttgaagaaataacagaatcatgtggcttccaagtagattagttttcagaggtgtcctgaagttacctctgagccagcataccctggagtaacctggttggatttcttttggactgtgaaacagaaagctttttggagaaatagagaaactgttcagtgctatgttcttccaaaacacatttctacccatgccacgattgatgggccctttagtgtcatgtagtatatagttggtgatcagaattttgagatgttatgattggaaaacaaactactttaaattatcaagccccagtaagagaaatagtgatgacttgaaacttaagaatttgtgactttctttcaaggaaaacgggttgagtcaaatgaacagatcccctttatacttattctttattaaaattcactttattctttagaggacatgtccagataaatatttctgtggactcttgaagataagtcttggctagcttagaaaaaatgaaagcaatgttgtagtgaagtctttctaggccataggatgtattttagaatatcctcagagccttaggatttttgagctgacttgcccctttctccaggtggaatgtcctctaataggatggttggcttatttttacataaaccagttgaagcttggatgatttttttgacttgaaggaatcataaagtgtagcttttgattccacttttagctgtaatctgctcttctgtgtaccaataaagtaaatgtcatgtaaataggaacacaggatagggttacttgttctcaaaaggtcatgtaccatctgcagttgctgagtaagtgttcctgtatctagggatgtttataactgtcttgtttccatttatttctgcagagtgtagtgaagctgatgagaggactactgcactgcatgatcagacaggtatggtattgataacaccttcctctctaataaaagcacattgtaatagtatctctaccctttagggaatgtttatagcttatattttctttcagtttcacaaatagtacacactaattttagaaaattttgaaaattggagagggataatgtcacccataatctcacaatgtaattaccactggaatgtttctttccagtcttttttgaccctctacaaatgattttcaatgtgtttcatcattactgtacatgcaattgtgtatgtagggtgaaaagatgatacaggtttaaaaaccctcatttgaccaggcactggtggctcatgcctgtaatcccggcattctgggaggccaaggcggatggattgcttgagtccataagttcgagaccagcctgggcaacatggcgaagcgttgtctctacaaaaaatataaaaattagccgcgcatggttgtgtgttcctgtagtcccagctacttggggttagcgggggtgaagtgggaggatcacttgagcctgggaggtcaaggctgcagtgagccaagatggtgccactgcactccagcctgaaacccagtctcaaaaacaagtaaacaaaatgcacacacacacacacacatgcacatacacaaaaccctcatttgaaacccttggggccatcaactttagaatttaaagtttttcagattttaaaaaggcagtacagtgcatactcctgccaacctttaattatatggtgtatggtatatatacaccatatattaccttatgccttctgcgggtctagaacagcactctataatcagaaacattaatatctctgtagggaaacatgcaatttcatactaagtagaataaataaagacttaatttgaatctggtgttgccaacaaatgaattttaatgcaaaatttaggggaaaagccttttcaaagtgtttcagattttaagattggagataagaaaccttgaatttgcatctccttgcagtaatttgcattttcctgacctccagtgaagttgagcatccttttatgtgtagattgaaaatttgcatttcctcatggatgaattgtctgctaagtcctttgcctatcatctaggttctctttcctgcctgttgaaaagttattgtacattatagacattagtcctttgtcatatgcattgcgaattttttagcagtctatcatttatttttgaggcttgtttgtgatatttttgcatacaagagtgtttttactttaaaaaattgttttatcctaggagatcttaaagcattttgcccacactcaatcttacctgtcttttctgaagatcaagattgtgttttattagaagaagaaattgaggcccggattgctaaagtgactgcctacaggcacagaagtctatagtagaaggaaatatatagtagatagaaagtagtacatagaaatatatgatagatagaaagtctttgctactttattttgtattttagatatttgcactttcgtttttttctttttagataggggtctcactttgtcgctcaggctggagtgcagtgatatgatcatagctcactcactgcagccttggcctctgggctcaagtgatccccccacctcagcctcccgcatcactgggactacaggtgtgcaccaccatgccttgctaattaaaaatttttttttgtagggatggaatctcactatgttgcccaggctggtctcaaactcctgggctcaagcgatcctcccaccttggcctcctaaaatgccaggattataggcatgagccaccttgcctggccaatatttgaactttttaccttaccaaataggtttaaggtcactaatttcaggaaccaaatttaaggtataacggttactgtcatacatcagaggcattaattatcaaatttaaatttcaggaactaagtctttcagttgtcctttgcacaatatttccttctgacttctagttttagctttctgttttgaacccaggaaatctgagacagatctcagttaatttagaaagtttattttgccaaggttgaggacccacccatgacacagcctcaggaggtcttgaagacatgtgcccagggtgattggggcacaacttagttttatacattttagggagacatgagacatcaatcaatatatgtaagaagtatagtatattagttccatccagaaagggtgagacaactgaaagcaaggcctccctccactatgggcttccaggtcacaggtaggtaagagacagatggttgcattctcttgagtttctgataagtctttccaaaggaggcaatcagaatatgcatctatctctgtgatcagagggatgactttgaatagaatgggaggcggattttccctgaccagttcccagcttgtaggggcccaagttattttcctttcacatccccccacctttgttttttcaaatcttttggagaaagcattttacaagaaaatgaatctctgatctcaggtttcgcctgatctctcatgagtaggacagtttatttctagatgggtaggtcccaaaagctcatttttagcaggttgtgaagtctcatatcctgtgaagagaaaatggggggaggtaagggagaaaaaacaataacaaacaaaagaacaatcctggaaaaatcagtataggccctattactctgaagtccatacattattaggcaggtatgaaagtggcttatgaatgtaaataggttactgttgttttttgagatgaagcctctttctgtcacccaggctggagtgcagtggtgtgatctcggctcactgcaacctccgcctcccgggttcaagtgatcctcctgccttagcctcctgagtagctgggattacagatgtgcgccaccacactcggctaatttttgtatgtttttagtagatatggggtttcaccatgttggccaggctggtctcaaactcctgacctcaagtgatccaccagcctcggcctcccaaagtgctgggattacaggcataacccaccgtgctggccaattactgttatttttttctgaagtttgagttgtctggcttcagttcccagggttttaagaaagcacagctgagttttcagggactccaaattaggaaaaatgggggaaaaaaaggaaggaaaaagttgaaaacattattttgaagacttgtagccaaaaaaaattagaattccatccaaactgtagaaactaataaaaattgaaacaaaaattaggcaagactagaatctaacaatgggtgtcctatcgttttgaaatataattttttctctctccggtttccccttttactaaagacaaatcatggtaggactggtttgcttattatacttggcctaattatttgtatacagtgcagcaagaataattattttttacataggcttttaaatgggctttgatggaattttgttccataggaggaatctcagataagatttttttcttgagatggagtcttgctctgtcacccaggctagagtgcagtggcacgatctcagctcactgcaacctccacctcctgggttcaagtgattctcctgcctcagcctcccgaggagctggggttacaggcgcccaccactgtgcccggctaatttttgtatttttagtagggacggtgtttcaccatgttggccaggctggtctcgaactcctgacctcatgatccacctgcctcagcctcccaaaatgctgtgattataggcgtgagccaccacacccagccattagttaagacttcttgaaagccgagcccagccatgaatttatgccatcaaatatctatgagttgtttgaatttctcctcctcttggggttccaagataaacctgaggcttctgtgcctgtcggaaagtgacattctttacttaccaagggtcagaaaccctatatgtggtctgtgtacatgaaatatgaggccagtttttccaagggctttattggcttcacaagtcaagtttgattctttaaaggaaagcacaccattccagtcaaagccttggtaaaattaccagtttctccaactgtgtcccgttacaaatgaaaacagattcttattgcacttacgcaaataactgtattgccataagttaagaatactcacaaatagtttccaaattctagagaaaatcaggtagagagaaataaatatgctccaaatcttttttatggcagtatactaaattgttaaaagctgtcagtagctcaaaagaaaagttttaagtatctgaaaaacaaaacaaaggatcagcaaacattttaagcaaaaagtccaaaaaattagttcagtccatgcagttatttcttgttctgcttgatattcatgaacattttagttctccatgagtcctggaaatttttcctctattctgatgtcacaatcttcaaaagttatcagaaacctgcatttaagagcacctattggaattttatagctgattataaaaccgtcttctaaaaaggaccaaaacaagacaacaattgtccatggatgaaaaaaaagttttaaggcagccataatcaaaagacacaattgacaaagaaatttgttacctctgtggcacacaataattttaacataacaattaggaatattactgataatgtacactaagttatatcagaatttcaggagtttctcataattttggaacacataccaataacatatttatacaaatacagcccaaagaaaaccaaacaacatttcatatttgacagtgcttcctgtataatttttataccaaataagccaaattatgacatttttggacttcagggaacctaatgtcttaaaggattaattaggttagaaaaagacataatttataatttgattttggaaaatttgtcaaatataaaagtttgaaatgcttgatattacaaaagaatattacaggtcattgtttaaccaaagtgataattcaaggacttcaaaaaaagtgaaaaccttaattctttgagagaagagacttaattttctaaacaagaagccctaataaaaacagcatgaagccaattacatttgtttttcaaaattttgtaaacaatctataaagtttaaccttgattataaaatataacttccataaggcttttataacctttattaaggagttggaggagttggttaatgctttaagaaaaacctgttaatctgacacaggggtccatatactggttttgcatcagtgtgcctttcatactaatgattaatttatagagaaactgaacttattttatctttaaaaattggcctttacaatctgtgcactgtcttcttccacgatagtccctggctcatgaggaatcaaatagctttaattgttttttgccctgtatttcaggaatgcagcttattttgattggcatcttccatggggcctgaagatgaggctttaattgctgttagtgtttaagatttagcaggacttgatgtcctttttagacccaggagttaaagccctctaactcaatgtcacaaggactttaaaagcccatataggaagatacatggatgtaataaccttagtttaaaaaaatttttttttgttaatctcagtttttttcctaagcaaaaccaaaacttaataataatatttggactttctggtttgtcctgaacatccctctttttttttttttttttttttttttgagatggagtcttgctctgtggccaggctagagtgcagtggcgcgatctcggctcactgcaacctccacctcctgggttcaagcaattctcctgcctcagcctcctgagtagctgggactacaggcaagcacgccaccacacccagctaatttttttttgtatttttagtagagacagggtttcaccatgttggccaggatggtctcaatctcttgaccccctccacctgcctcggcctcccagagtgctggtattacaggcatgagccactgcgcctggcctctttattcttataactttctttacatctccttttgtttcctggttgtttttaccttgttttatacataacctttaaataagctttgaattagacaaaacttgttcaccttttattttttagcaagaatgttttcctacaatatatatttattggaaaatacccaaataattaaatatctattatttaatataactttatatcctaaattatgaccagtttttctgcaagtacttatcctattacatttacgtaattattttaattgttttaccctgattatttatgaaaactgtgatagtcgtgatttaaagttatgaaactgccattgaaaattatgactgagacagtgaaaaaagatttgacctaactgactccatcttgctcttagccccaagccgtccttgttcactcctgggcataggccaaactaactttgggaggaatttagcttatagattagctttgaaacaaagagaataacagtcctttcccaaaacaaacctccttattgtctgtgcatactgcctaaagccacaagattcgaagttacggtaatattactaaattcaagatgcagctattttcattaagcccatatcaatgtcttatttattaaaaattacacaagcaaagaatcgttctgttttgggctgggcttatagtttgtaacccctatgccaaattttgacacctgatagtatttggcagggataagtatgaaattgcttgattcataaatgtaaaacaaaagaatgtatactggcaaatcttaagacatttctaatgttactttaccaaataattttaaaactagcttatttattacagattttacttaagttacataaacttcaaaaagcatttgacaattcttttttagtatctgatttaaatgcttttatttttctttaagccaattaattagatctcttatatatgtttagtagtgaaacagtgtgtacacaacacataattacatataaggacacattaggcatgccaatggatttataaagaccccctcttttttttttcttagattttcatattcttgataacctgtttcacaaccctacacagttgtcagctaaacagctttaaatttgcacattgaaggaaacagttcaggtgaaatcaaatagcaaaatttacatcataatgtacagagagaaaggtctggtggtgcagaactacagggagatgcttttacagtgcacttaaaaaaaatttttttttttttgagacagagtctcgctctgtcacccaggctggagtgcagtggcgcagtctcggctcattgtaacctccacctcccaggttcacgccattctcctgcctcagcctcccgagtagctgggactacaggcacccgccaccatgcccggctaagtttttgtatttttagtagagacagggtttcaccgtgttagccaggatggtctcgatctcctgacctcgtgatccacccgcctccgtctcccaaagtgctggtattacaggcgtgagccaccgcacccggccaaaatttttttaaacaaagacatttctgagtgtcttccttaaaaacccaagtgtagcctctgttgcgataactattttagtcaaaaaatcaggtgaaaacagaattcagtcaactgagaagaaaaaaaaaaaaacttttgctcaaaaaaaagacaaggtcttaggagaccttgtttttttttctcaaagaaaatcaacctcaaaacatgaaggccttttaaatacaaacatgcccacatgcacacatatacacacacatcttggatgttaaccttttaattaagccgacttttaaccattgagctcttttaaaaaaaatcttttaaaatcttattactgtatttcagctaggacaaaatgctgctaaactaacaatcatcacacaaattctatgatttctgagcactctaagtgtaagcagaatttaacaccagctggttgttaatgctaacttcagtcatttaaaaagaattttcaagacagaatcccaaaccagtttcttacataatgatgggtctcaggctgtagactgctctctacggtcctagaaacaggaaaaacaaaaacaaaactcatcttccccgttagaagcgtgttcaaactccataaaggagttacctgccttccatcgacatggaggcaggaaaacttgctttccttgtgttggaagcaagtaaaactccaaaaaaagaggagttgtaacagcaaaataagctttagatctcaaccaaattttgagagatcagggattctgttgagggggtgctctcaggcctcagcaaattgtcctgttggtttgagccatcaagttagctcatgctggtaccaagcaccaacaggagatttgtcaaaggtcaggggcatctccactcagaatccaccccaccttgaggttaccaaaatgtgaaccctgaaaatctgagacaggtctcagttaatttagcaagtttattttgccaaagttgaagatgcgcccatgacacagcttcaggaggtcctgaggacctgtgcccaaaatagttggggcacagcttggttttatacatttttgagagacatgagacatcaatcaatatatgtaagaagtacattagttcagaaaagctgagacaactcaaagcaacgccccacaactgggggcttccaggtcacaggttggtgagagacagatggttgcattctcttgagtttttggtaagtctttccaaaggaggcaatcagaatatgcatctgtctctgtgagcagagggatgactttgaatagaatgggaggcagattttccctgagcaattcttagcttgaaggggcccaagatattttcctttcagactgtcatacctttactccctcactctatgtgtctctcagcagctcttttcattactccttcaaaatatatcctcttattctaatttacttcgaaatttctacctcagtttcaggaacaaatgtatcttttcacattcagttacctcttactaagctgttctcactcaagcactctgaatctcagtttatctacaatgtgcagtgtggcaaagcaaccatatgaagagtaaacaagaggcaatgaataggaaagagctgtttttgactatttggtattattttctgattaaatcacctaaattgaaaaacaacaataacagactttccagttatattagtgcagggaaaaacaggtaacgagtattttaaatattcacaattgcctgaagatagtgtatcttcacattgcaataatgtatgttagagtattacagaagtgtggcatatgggttgatttttcagtatatccttcttttaatgtttttgttcttttcaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggtcagtacaaggagagaagtgctgggagcccctgagcatggagtctggggtactaattaatattcttttaaattgagaaccgggaaggctggggtagatcttcatgaaacaggtattttttattatttattaattctcagatatcatgagatggcaaagaagggctaggtttcattgcttgttctcattacagtacattgacaagcctgccagttagtataaatacaaactcaatcacctactttatgctactctttatgaatatattataaacaaggcatctgtctataggcatctaaattatattaagaaaattaacttaggaatcagaatccaaattttttaattattgaatactatatccttttcagatggttctcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactagttaggaagttagtgaaatactttaaggcaagattgattcagaatttatgtaaggcagttaccttgagaatgaaagggcatatgtgagatttaagtggtagtatgcaagatcttcacagagtatttagcaatgctctacacatttttgaatacacaaatctccaccttggttaaaagagaggcttagacagaacttgactgcaacttacagaatgggggcaggaggggctccatggaacctcccccagcaaaacaaccataaatgttgaaaattattttttaaaaaccagccactacattattggaaattgtctgaaggacatacagcaggtagagaaacatttactccaggaaatctaccaagtattggtaaaagcagtgagggagtgtggcatttgagtctaaatctactcccccctccaccccacctcagcatggcagaagcaatattcaaggcgggtacaaccaagagcacaatctccccagctagttcccagtttagggacactgtatctctctgagggaggtaaggagatacatcctctccagctccatgttgcaaaagctagttcaggcaagaatagctgacaggcctggagttcccctcctccccaggaaaaggcagggtgagaatgctaggccctgattaaccttggcccacttcactattagggtggaggttccccactgggaggggcaaactaagaagatcaaaggctaccatcccttcccagcactcaatttgtaaagcaggggtgtcactccaaaagaagtgggccactgttctcaccactagctctggagcactggcacggaaattttgctggggagagaggcaggctgtaaggacacaaagctctgtagcttttcccaaaggaattgactttatttaacagagtgtggaaaagttaaagcctaaaggcaatctcaaaaaacaatggagatttgggttctaagcaattaagaggaggctagtagctcaataagagcaagaagctaaaccatatactagctcaatggcacatggaacatttttcaggatagattatatggtataccataaaactagcctcaataaatttgaaagatttcaaaatcacacaaagtatgttctatgaccaaaatggaatgaaattaggaacagaaagaaacctaggaatctcacaaatatatggaaattaagcaatacacacctaaatgaccaatgagtcaaattgagaaaatactttgagctaaatgaaaaagaaaatacaacataccaaaacttataggaagcagagaaaacagtgcttagagggaagtttatacctgtaaacaccaatgtaaaaaaaaaaaaaagaaagaaaaatcagtaacctaacctcccaccttaaggcactggaaaaagacaagcaaactaaacccaaagcaaagagaaaggatgaagtaataaacattacagcagaaattaatgaaacagaaaatggaaaaaacaatagagaaaatcaacaaaaccaaaagttcattctttaaaaagatcaacaaaattgataaatctttagctacattgaccaagagaaaaagagaggatactcaaattactaaaactaggaataaaagaggggacatcactacaaccttacaaaaatataaagaactaaaggggaatactatggacaactggttaccaaaaattagataattttgatgaaatgggaaaatttcttgaaagataaactactgaatctgactcaagaagcaaaggaaatctgagtagacttactacaatcgaagagaattagtaatataaaatctttccacagagaagtaagcccgggtgcagatagctttactgataaatctaccaaataaagaagagtgaacaccaattatttacaaacacttccaaaaatagaagaggtgacacttgcaacctcattctgtgaagccattactctgatgctaaaaccagacaaagatatcacaacaaagtacaattatagatcaatatctcttattaatatagacataaaaataaacaaaatactaggtaactgaatccagcaatatattaacaagtttatataccttgaccaaaccatatatattccaggaatgcaaggttgttttattatctgaaaattaatgcaatacatcatgtcagtggaataaaggacaaagatatattattgtctcagtagacacagaaaaacatttgacaaattcaacaccttatcatgataaatacttaccaaataaggaatagaggagaattttttcaacctgataaatggcatctttgaaaatccacagctaacatgacatttgatggtgaaagaatgaatgcttttccccatagatcagaataagacaaggacatcaactcttgccaccagtatctaaaattgtactggcagtttagcaagggcaaatagccaataaaaagaaataaaaggcatcaaataaatgaaggagtataattatctccatttgcagatgatacgttcttacatagagaaatcctaaggaattcattaaaactctagaataaacaaagttcagcaaggtaacaacgtacaagataaaaatgcaaaaatgagttatgtttctaaacagtagcagtgaataaccaaaatgaaatttaaaaataatttctattacaataggatcaaaaatgaaataatgaggaataaatttaacagaagaaatataaaatttgtactttgaaagatatgaaacattgttgaaagaaagtaaatatctaaataaatggaaagacatctatattcaaggatcagaagatttattgttaatgtggcaacatttcccaaattaatctacagatttaacatcaactgactttgcagaaattgacaggctgtttctaaaatttatatggaaatttaaaggacccagaagagctaaaacaatcttaaaaaagaagaaagttgaaggactcaaatttcctaatttcaaaacttactacaaagctatattaattaaaacagtacaggtactggcataactatagacatgtagctctttggaatagaattgagaggttagaaataagccatcactttatgctcagttgatttttgacaaaggtgccaagataattcaatggggaaagaatagtctcttcaacaaatggtgctgggacaactgtatgtccacatgcaaaagaatgaaattggacttcttcctcacaccatatataaaaattaactcaaggctgggcgcggtggcccatgcctgtaatcccagcactttgggaggctgaggtggcaggatcacttaaagtcaggagtttgagaccagcctggccaacatggcaaaaccccgtctctactaagaatacaaaaattagccaggcgtggtggtgtgttcctgtaatcccaactactcaggaggctgaggcaggagaatcgcttgaacccgggaggcggaggttgcagtgagccaagatcacgccattgcactccagcctgggcaacagaatgagactccatctcaaacaaacaaacaaaaaaagaaattaaatttaaaaaattaactcaaaataaattgtaggcctaaatgtaagaaggaaaactaaaacactatattagtctgccacaacagaataccacagaataggtggcttaaacaacagaaatttattttctcacagttctggaggctggaagtccaagagcaaggctggtagggttggtttctggtgaggcctcatcttgcctttcagatggctaccctttctgtgtttttacatggccttttctctatgtgtgtgcactcctggtgtgtcttcctcttcttataaggacggcagccctattgggttagggccaccctcatgacctcatttatcttcttaattatctccttgaagtccctatctccaaatatagtcatattaggggttagggcttcaatatacaaatttttggggggaggacacaattcaatacataacaaacacttagagaaaaatacaggagtaaatgtttctggccttgggttaagaaaaagcctcttagatatggcacgaaaagcataagctactgaagaaaaaatagataaactggaatgtatcaaaattaagaacttttgtgcttcaaaggaccccatcaagaaactaaaaaagcaaccaatagtatagaagaaaatattcacaagtcatatatctgataaggtacctgtatctaaaagaactcgcagaacttaatataaaagataaataacctaattaaaaatggtcaaagaatcagaattgacattcctccaaaaagatgttcagataaccaataagtacatgaaaggatagtgaacatcattaattttgaaagaaatataggtccaaaccacaatgagataccacttcacacccatcaggatgactgtaatcaaaaagacagataataagtgttgctgaggatgtggagaaattggaaccctcatacactgctggtggaaatgtaaaatggtgcggctgccttggaaaagagtctggtagttccttaaaaggcttaaaaaagagataccatatgatctagcagtttcactcctaagtatatatatacccaagagaaatgaaaacatatgttcactcaaaagcttatacattaatgtttatagcagcattacttatgatagccataaatgaaaataacccaaatgtttatcaactgataattggataaataaaatatgatacatctgcacaatggaatttttaaattttttttcatgttactgctacctctcaagatggaatattttgggcaataaaaaatgaattacaggtacatgccacaacactgacaaaccttgaaaatattatgctaagtgaaagaacccagacataaaaggccacatattgtatgattccatttatatgaatgtcaactaaggcaaatcatagagacaagaagtagattagtgattacttaggctggggggcaactgtagaagggaagtggggagtgactgctaaggggcacaaggtttcttttggagtgatgacagtgttctaaaattgattgtggtgatggtcgcataactgtgcatacactaaaaaccgttgaatatatacttcttatgcatgctttttacatatctcaataaggttgtttctaaaaatgagagaaagaggcttaatgttatacagatgagtgcagaatataagtgcaatagaccactgatttagctccatttctggagccctgtatgccttagtattctttatatagtcacctttggtctaatccagccctatctcattttatgtgtactcacctctgcattctttgttcgacaagcagtgtctgggctctacaggaggcacaggatccagaggtcctccatttatgacctttcctcaagaggctgatccctttcctgtggttaacagaggtgtttaaaatcacttaataaattttcaaacatctactgttcaatgctatttaataccgttcagaatactacgtgagatacttttagtggctatgtgagataattttagaagatgcagatataaataagatgtagttctttccttaaaattcaagtacacatttgtctataatacagagtaaaaaaataagttcataaaagtaagaaaaacaaaattctgtgaatcacaaaataggagaatcaatgatagcatcacagaggacatagcatttgagctgagccttgaaagaacagtaggatttcaagatctggagagaagaaggccatttaaatggagaatataacaagcaaaaggacataaatggtagaaatgtctggcatttgtatgatatagctgtgatgcaagtctaacagatgaataataccagtttcatacttttgccttctctgtctctgctcaatcgcattgtcacacaaagatgacaagataaagctatgaagctgatgtcccatgtcactatcatctcttctctttaccggcgtctttccaagaagttagtgtcattacgattgcaagaaaaaacacactttgccactttgcttctgcagcttccctgtgctatggatgctattttgacagagccatggatcaggaggagtttgcaatctgataataccaatcatatagttctttttaattataaagttacacagttccatgatttaaaatatatgttaatagatcaaagatttagatgtggccaggcgcagtggctcaaacctgtaatcccagcactttgggaggcttaggcgggcggatcacaaggtcaggagttcaagaccagcctggccaacatggtgaaaccccttctttactaaacatacaaaaaaattagccgggcatggtggtgggtgcctgtaatcccagctactcaggaggctgagacaggagaatcacatgaacctaggaggcagaggttgcagtaagccaggatcatgccacagcactccagcctgggcaacagagcgagactctgtctcaaaaaaaaaaaaaaagtttctgataataaaaaaatactataaacaagtccaaattccaacaaactagcaaaaatacttgcaacacatatgatgtgcaacggactaatttccttaatatttgttaaaatatcaataatagagaaagaagttttttttaaagtttaatgctgagcaaatacacacacacaaacacacacacacagtatgtttgtgtgaaccacagaaaaggggaagcaatgacagcatcacagaggagatagcatttgagctggaacttgaaagaacagtgagatttcaagatatgggaaggaagggaaggccatatgaatggagattatgagcaaaaggacataagtggtagaaatatgtggcatttgtatggtatggctgtgatacaaatctaagagatgaataaggccagtttcatacttctgccttctctcagcctctgatttctattgaattgccagtctttctggcaatatatacttacaatgcatactttttatgtatctcaataaagtttttaaaaatgacagagaatgaggcttaatattatacagatggtgcatgtatatatatgtatataccaagaccatacatatgccattttatatatatatactaagaccatacatatgcaaagactggtatatgtatgtaccaggaagaccagcaattcagtaaaaatctgaaggacatgaccaaacagttcataggaaaagaaatatgaaacacagatagcttataaatatatcaaaagatttacaaccttactcataataaaaaactggaaattaaactacaaggggcttctatttcttatccactaaagtgagacaaagattaaaaattttttttaaagcctgtgtttgcaaagatgtagggaaacaggcagtcagtgttggtatataaactgtagaatttctttgaagaataacttggagatgattatcaaaatttaatatacatgatgaagtatttagagggaagtgtacggatatctgcagcttactctgaaatgtatcaaaaaggaagatggatagatatatgatgaacaaagtatactaaaatgttaatggtggagttcagatggtgagtatacaggggtcctctgtaaaattgttccatatttttctgtttgtttgaaagtgttcataataaaacattggaaaataatatgcatacatctttgggtcagcaattccaagaatctgccctgatatactggcacatgtgcataaagatatatttccacaaatactcattgcaacattgtagtgaggaaagatttgatacaaccgaaatgtccttccgtagggaactggttacatgagtaaccgttcagtgaaatgttctgtagctattaaaaaaatgagacagatgtatttgaaattatctccaagttacttatatatgaaaaagcaaaatgcagtataatatacagtactaccctttgtgtaatgtttgtacatgcataatatatctctgaaaggatacagaagaaactggtaaaacaggtttctccagagagatttggcagtggtgaaggtgatgtggttctgggtaggaggaagactcactggttatccttcggcacagtttgatttttttcatgaaagagtattactaagtgctgacttacgaagggcgtgttaggtcttagaattctttctgaactggaatgggtgttcaggatattcacagtggagttcatttgaaagctgacattaagaaacatttgacaatcattttacatcatgcttctaagaatgtgagaggactttttccattctcaagtccttttaaggaagtttttttcatctagatctaattgctctagatatgcccactgttcagcaaactagaatttcttggctttttctggctaacacaactacatagctggcacatgtactcatttccattaaaccaacacatctgtttttgtgacaaatgcgaacaaaaaatgttttgtttaaatagaatagcctccaccaagtaaatatgagaagcttaaaagtttagtctctatagctaacctgatgttcactttttcctcctgtttgttatagaccagaaaggaaaaattagcttcctgatttttaaattctgaaatgatttcttagtttagaatcaaatagtccaaaccaagtctttcatatgtaaacagtaatatttattgttataaaagaggtatattaaaagttaactgcttagtaaattttaggtgtataaaaacttttagtgctcaggattaagtaattttgtataaaattttatgaaatatatcctgcagttttctgatttattatgattttgctttttaatataactttaaattacaaaaaattacaaaagtagcacctgtttcttgtagaatactgtaaaattgcaaaaatgtccagaaaagataaaataaaactaccttgaatctcaccaccaaagataactgctattaactaacatcctcctggttatatatttgtgtagttctgtatgtttgaggggggagatataaagagaggagtttttaagcaaaaatggatcatattatacatattaggaggcagtatagcatcttacctcctaatgaaactgcattcagcattctctgaaatgaaactgaaatcaacagtcaattgagtcccggttccactatttgttagttacatgaccttaggaaaatttttaactcctttaagcctcatggagaaaatagaggtgcttacctcttagggtggttgttgaaaaattaaatggataattcatgtaaaacattctgtgtgtaagttataatatctttgtatggcttacatttagaataattatcatttttacttaaaaatgcaatttaagtcctttttaaaatcataattttatctatttcttgcttagtatttagaccccttccagctcagttttgaaatatttgtcttttattccccaagtgcttaggtttgtacatttaagcatattataaattagttacctatagaatcagattttactttttggtaaaatctgtaaataacagttaaaattcttccatgttgaaatatgcttatatctcgcttagttggagactagcctaggacttgtttgtggtcttgtttttatagtttaagatcaaagtgccttccattgttcctaggcaggagtaggattgcttgggattagtgagatcagttagtcactatggctgcctataaagcttatagtgataattgaccagttctgtatctttattccctctttcctcaggactccatatcatccacagcctagatgaagtcaatttcatacagaaccttgtgttttacattgaagctgcatataaaactgctgtaagtactgattttagaatggattttagacatatgatgtttttgttttctaaatactgggcaactcagttgttttcttaatgctactgctcatagtgaaccaacctaaaaggcttctggcagaaattgtctttagcctctttctttattaagacctgtcatcctgtgtcttctcttcaagggggttacagagacaagagggtcaggatgctatactttcattcctttcaaactctgtgatatctcatggtatgtatttggcaatctgggctaaattgtggtcttattttaatgatttaagttcttaagagcaagatagctaggttgtattgtgggtcagttagctacttagaaataaaatttagtcatgtttgtaatattatctgtaggtgttgattcagtgcttacaatgcaaataagttatttttccttacaactaccatatgaggtaggtttctgttaaatcataatatatttaacatcttctctgtataaaatgttaagttagacactatacaggaatgcgatttttttcttcttcagtctaacatagacaacttttctttgttgttcattgaagctttattcataatctccaaaactggaaataacccaaatatctatcaacaagtaaatggataaacaaactgtggtatatccataaaatagaatactactcatcaataaaaaggaatgaactgttgattcatgcatcagtgggtgaatctcaaaggcattatgcttagtgaaagaagttagacaaaaaatgtacagactgtatgattctactcacataaaattctagaaatctatagtgacagaaagcagatccatgattgcctcaggagaggagcagagggagagataaattacagaagagtatgaggagacttttggaaattttacaaatattcattattatgatgatagtttcacgcatgaaaacatatcaaaattaatcaagttgtacactttaaatatgtgcagttctttgtatatcatttatacctccataaaaatacaaaagttgttattatttgttgaatctgtgtttccatttctgtttctgtttttgtctgttgcccaggctgaagtgcagtggcatgatcgaggctcactgcagcctcaaactcccaggctcaggtgatcctcccacctcagcctcctgagtagttgtgactaaaggtatacgccaccacatccagctaatttttgtattttttatagagacgaggtttcgctatgttgcccaggcaggtctcaaactccttgactcaagcaattcaccctcctaggcctctcaaagtgctaggattacaggcatgagccaccacacctggcctgttttccacttcttactaaccaccctcctcctttgtgaccaacacattattttttatttctgttaattggacagttatcttttaagtatatttaaataaaaattagaaattcatttaccatttctggtgtacttcttttcttcatgtagattcagatttccaactggcattatttccttctgcctgaaaaactttcttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcccggacggggcggctggctgggcaggggggctgaccccccccacctccctcccggacggggcggctggccgggcggggggctgaccccccaacctccctcccggacggggcggctgacccccccacctccctcccggacggggcggctggccgggcagaggggctcctcacttcccagtaggggcggccgggcagaggcgcccctcacctcccggacggggcggctggccgggcggggggccgaccccccccacctccctcccggacggggcggctggccgggcggggggccgacccccccacctccctcccggacggggcggctggccgggcagaggggctcctcacttcccagtaggggcggccgggcagaggcgcccctcacctcccggacggggtggctggccgggcaggggggccgacccccccctcaacctccctcccggacagggcagctggccgggcggggggctgacccccccacctccctcccggacggggcggctggccgggcagaggggctcctcacttcccagtaggggcggctgggcagaggcgcccctcacctcccagatggggcggctggccgggcggagggctgacccccccacctccctcccggacggggcggctggccaggtggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccaggcggggggctgacccccccacctccctcccggatggcacggctggccgggcgggggggctgacccccccacctccctcccggatggggcggctggccgggcggggggctgacccccccccacctccctcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtcttggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagcgcgccaaccaccagccgcggccaccatggccagacgggctccctcgaaaaactttctttaacatttcttcattcttctagtgatgaactatttcagcttttgtatgcctgaagaaatctttatttcatcttcatatttgaaaaatattttcactaggtttagaattttatgatggcagatgtttttgtctttcagtactataaaaatgttgttccactttcttcttgcctgtattgtttctgatgacaaatttgttgtcaaccttatgtttgttccgctacatgaatgtgcctttttctgctgtctgcttttaaaagtttcttttatggctgggcatggtggctcatgcctgtaatcccagcactttgggaggccgaggtgggtggatcacctgaggttgggagtttgagaccagcctgaccaacatggagaaaccttgtctctactaaaaatacaaaattagctgggcgtggtggcgtgtgcctgtaatcccaggtacttgggaggctgaggcaggagaatcgcttgaaccccggaggtagaggttgcggtgagccaagatgatcacaccattgcactccagcctgggcaacaagagtgagactctgtctcaaaaaaaaaaaaaaagtttcttttattactgactttaaacacttcgattatgatatcccttggtgtcattttcttcacgtttcttctatttagggtccatttagctccatagatctgtgcatatatcgctttcatcaaaagttttcagcaattatttcttcatattgtttttatgttcccccccttccttcgagtattcaataacatgtgtattaggctgtgtgatgttgtcccacagctcacagatgtactgtttagttttttaattcttttttccctctgtgtttcattttggatagcttctattactatgccttcgacttcactaatctttttatttacaatgtctaatttgtcactaatcccacccaatgtatttttcaggtcagatacagttttatcgctaaaagttgaatttgagtctatttttctatattccatgtatctactaagctttctgaatgtatggaatatagttataatacatgctttaatgtccttgtctgagtattctaacatctgtgtcagttccaggttggtttcagttgattgatttgtctcattatgggctatattttcctgcttcttggcatgcctagtaattttttactggatgaaagacatcatgaatcttatcatgttgcatcctagatattgttgtattcctgtaaatattcccgagctttgttcagggacctagttaatttagttgaaaacagtttaatccattattacttttaaaatgtgttttgtgggaccagagtcatgtctagtctggggctagttattctccactacataggtaagacacttctgaatactctaccccatgccccctgaattatgaagttttctagtctggctagttgaaacaggcactatttcttgtcctgtgtgagcactaggtattttttccctttaattctttgggtggttctttccctagcctcaagtagttttctcacttacatgcattcttcattattctgctgaatatttgagggggaccctctgcagatttctgtggttttctgtgtagctttctcttctccgttagtctgtcctgcaaattatggttaccttggtgtatctgtacttagcgccatttcctcaactcagggagtctgccaggctctgtttagttttctccttcctgtatagtggcctgcaaactcttacaacagtaagctgggacagtcataggactcatcctatttgctgccctttctcagaaatcactgtccttcattgtgtagtgttcattgtattgaaaaccattatgttataaatagttttttagttgttgcaggtgggaaggtaaatctggaacctgtgacttcatattcaccagaagcacaaacctaacatagataattttatgcaagcagacattatttgttgactgatggctttgcttctgacaccacaggcctgctgtggttcagtgcggaagttagggttctttggcctctccattatatccaatgattataacagtagaattattgatatttctgtattctcatactctaacctttgctgcacaaactagaatggagctggattgggggacagataaggccagtcatgggttaaacatggcttaccttcctgaaacttcactttaactcagagatttggcatgaaaagtaattaaaggtagatacagagatacagatgtgtgtgggagggtgtgtgtttgtgtgtatgcacatacacatttgcacatgtctgtttccaagttccatttaatgagagggcctagaagcaatgacacctcagtgacaatgagtgtacccagtgcccaggtcttggattctgactctcattttctgatcaagtaaaccaggacttcttatgaaagtggttgattccagggctatggcggggaaaatatgagataagattggagcatcttacagtgccaaaaagtgaagaaacgttcaaaaagggagtgttttattttgttatgttttgttttgagacagggcctctctttgtcacccacactaggattcagtggcgcaatcatggcttacttcagcttcaacctcctggactcaagctatcttgccacttcatcctccctagtagttggaactatagaagcaccatcatgcctgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaacaaaaaaatagtaacagtggaattgagaaacccagcagacatcacgttaaccaagtgatgagggttaatatcaccagtaataagacgtatcagcattgtatatccctgctatgatgcactgagaaggacacagcataatgtctgtaatacatattcttgcctaaaatgcataatctcagtctagtctaatgagaaaacattaagcaaacccaaattgaggaaaatctactaaatacctgatcactaatcttcaaagagtgtcaaggtcacaaaagacaagacttgaggaactgtcactgattagaagagacttaaagaaacatgacaaatgcagcatgaaattctggattggatcctggaatgtaaaaaggccattggtggaaaaagtggtaaaatccaaataaagtccatagtttggttaatagtattgtgccaattttaatttcttagctttaactattacactgtggttatgttagacgttaacatcaggggaagctaagtgaaaggcatatgggaactccttgtagtgtttttgcaacttttgtataagtctaaagttattccaaaataaaaagtttttaaaagtaattttaaaggctatatgattcaggggatttatagagctctggctaagagggtaggctttggagtgagattccttggattctaatcctggctctgtcacttattaactgtgtgactttgagtgagtcacttaacttctctttgcatcatcagtttcatcatctataaaatgtaaggattaagaaagataatgtaaaatgcgtaaattagtgcatggtacgttgtcagtaccaatagagagtaaaattagaatgaatgtttacaataaaatattgggctgctatttaggctccatcttgcagatctactgggtatttgctttaatgaaaaattttgagaaacacctctccagatagacagagttatagttcttagccctcctgattaactgttgaggagtcttccaatggcttggaggccccagtagaatttaaagctattggcaaagtagctgcaggggccaccccacacattagcatctccttaataagcattgtgggtatatatatatatatatggcaaattagttactcctagtgtcttttattcaagggtaaacacttcctgcatctaggaagtatttagtagttatgacttgctaattgtatattggttattttatgccaggacttcgggatatgggaacgtggagacaagaccaaccaagggatctcagagttgaatgccagttcagttggaatggcaaaggtaattttcctttcctgtttgtactaagtatgggatgaggaagtctggtatccctttgtcacagataaaacttaatgtgactgtggaccataatcaaattaattattattttaaaccacaggcaacattcagattctcctgtagaaccatggatatgtagatgaaaactttcataagctgcagatttgatatccaactgcttttgtggcatgtctctacttatattatatgccataaggacttgaaaggacttaaactaaacttatcatctctaccattacaaaaacaagcaaaagaaggcttttattcctttcgtttaccagttgaccaagctttatatcaaggaatcatctttcaatcctctatcctctttattttcctccatcccccaaatcatcatcatcatcatcatcattagcagcagcagcattactattcaacttggctctactttttcatcctacccactattgtcttctctggaaacagcaagaagacatacaataagatagcaggaataagatcaaacatatccattatgagaaatatgcatgatttagtctgtcctactaatatgcaaagatatagattgattttaaaaaataaaaggaaatccaatatatgctgtctataagagctctaatataacaaaatgatacagaaaggttaaaaacagaaggatgagcaaaatacagtctgacaagcataaaatgagctagggtgactgtgaatgtcaagtgaagtagaattcaaagtaaaaaatattgcatggaacagagaggacaaagggagtcacaatagaattttattccatttttttattttatttatttttattttatttatttatttatttatttattattattattattattttttgagacggagtctcaccctgctgcccaggctggagtgcagtggcacgatcttggctcactgcaacctccacctcctgggttcaagagattctcctgcttcagcctcccgagtagctgggactacaggcatctgccaccatgcccagctaatttttttttttttttttagtagagacagggttttgccatgttgacgaggctggtctcgaactcctgacctcaggtgatccatctgccttggcctcccaaagtgctgggattacaggcatgagccactgcacccagcctaacaatctcatagtgcactgaacaacataaccaaacatccttctatgtcatttcacacagacaaatttagttcattcttttcagctgctatacagtatttaataattgctccattgacagaattgtctttattttttaacattctagataatgctttagtgaagatccttgtacatacatccaggtaaatttacacaaatatttttataggaaaaattcctcaaagtggaacccttaggttaagggatgtatacttttaaattgcccttcagatatgaacagacacttctcaaaagaagacatttatgcatccaaaagacacatgaaaaaatgctcatcatcactggccatcagagaaatgcaaatcaaaaccatagtgagataccatctcacaccagttagaatggcgatcattaaaaagtcaggaaacaacaggtgctggagaggatgtggacaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccacatgtccaacaatgatagactggcttaagaaaatgtggcacatatacaccatggaatactatgcagccataaaaaatgatgagttcatgtcctttgtggggacatggatgaagctggaaaccatcattctcagcaaactatcccaaggacaaaaatccaaacaccacatgctctcactcataggtgggaattgaacaatgagaacacatggacacaggaagggggaacatcacacaccggggcctgttgtggggtggggggaggggggagggatagcattaggagatatacctaatgttaaatgacgagttaatgtgtgcagcacaccaatatggcacatgtatacatatgtaacaaacctgcacgttgtgtacatgtaccctaaaacttaaagtataataaaaaaaaatttcaaatgaaaaaaaaaataaattgcccttcaaaaatatttccactagtttacatttcccatcctcatatgatagatatacgtcattatgtaccatagatgtcatttttcttttcttttttttttaatcatatgctgtttctttcagtgaatgaaagtgtttgacagagaaatacctttggaaacaaatattgagaacatgttattacaacttgtttctttttgcactggtacttattattacaaatttacatatagagcttttttgccacttttctcaaactctcactacctggatattatcaatatttttgtatatttgatttaaagttttttaccatttaaacttttttactttttattttgtaatcatttgtgacttagaggaaagttataataattgtacaaagaattcctatatagtacccttcactcaagttccctacttgttaatatttgctttatctttttctctgattaaacaaaacaaacacacaaacacacaattgtttttttctgaaccagtagagagtacattgcagacatgatgccccattactcctaaatatttcagtgtgaatttcctcaaggactcttttataaccatgatacaagcatcaaaatcaggaaatgaacactggcattatactgccacctaattgatatagcccattcaaatttatttagttgtcccaataatgtgatttatagcaaaaaaaaaaaatccttttgatccaggatccagtctaagataacatattacatttaattgtaatgtctctttaggcttcttccgtctgaaacagtgcctcagtccttacttgtctttcatgaccttagcatttttgaagagcataggccagttattttacagaatgttcctcgatttgattttgtgtgatatttcctcacgatataggttcaggttatgtgtttttggcaagaataccacagaggtgatgctgtgtccttagtttatcatcaggaagcacatgatgtgaatttgtcccattactgttgatgttatcttttatgacttcattaaggtggtatctgccaggtttctccactgtaaattttctattttccctttgtaattgctatgacttgaatgtttgtggtcccccctcaccaaaattcgtattgaaacttaattaccaatgtagcagtattgagaggtggagcctttaagccgtgactggatcataagggttcttccatcatgaatgcattaatcaattcatggattaatggattagtgagttatcatgggaatgggactggtggctttataagaaaaggaagagacacttgagctagcacactcaggccccctcatcatctgataccccattccaccttgggactctgcagagtttctacccgccagaagccctcaccagatggggccccttgacattggactttatcagcatgatgaacgggagccaggtgctattcctcaagacaatggaggaaagaccccaaggcatttcagagatcttagatgctgccttttccatcacaggtccaaaggcctaggagggcagaatagtttcaggggacaggcctggggtgttctttatgggctgtgcccaggactgccttggaactgtactcccggcacccctgcttcagtgttcactcagctcatgccactactccaaaaggtccaagtgataaaccttgaaggtatccatgtggtgttaattctgcaggcccacagaatgcaagagctgcagaagcatgacagtttccacctggatctcaaaggatatataaaacagcttctgttctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccatcggtctatatctctgttttggtaccagtaccatgctgttttggttactgtagccttgtagtatagtttgaagtcaggtagcgtgatgcctccagctttgttcttttggcttaggattgacttggcgacgcgggctcttttttggttccgtatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttctatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtcagagagggcatccctgtcttgttccagttttcaaagggaatgcttcctgtttttgcccattcagtatgatactggctgtgggtttgtcatagatagctcttattattttgagatacgtcccatcgatacctaatttattgagagtttttagcatgaagcgttgttgaattttgtcaaaggccctttctgcatctattgagataatcatgcggtttttgtctttggttctgtttatatgctggattgcgtttattgatttgcgtatattgaaccagccttgcatcccagggatgaagcccacttgatcatggtggataagctttttgatgtgctgctggatttggtttaccagtattttattgaggatttttgcatcgatgttcatcagggatattggtctaaaattctcttttttggttgtgtctctgccaggctttggtatcaggatgattctggcctcataaaatgagttagggaggattccctctttttctattggttggaatagtttcagaaggaatggtaccagctcctctttgtacctctggtagaattctgctgtggatccatctggtcctggactttttttggttggtaagctatccttcacgtctaaaacaccaaaagcaatggcaacaaaagccaaaattgacaaatgggatctaattaaactaaagagcttctgtacagcaaaagaaactaccatcagagtgaacaggcaacctatagaatgggagaaaatttttgcaacctactcatctgacaaagggctaatatccagaatctacaatgaactcaaagaaatttacaagaaaaaaacaaccccatcaaaaagtgggcaaaggatatgaacagacacttctcaaaagaagacatttatgccaccaaaaaacatgaaaaaatgctcatcatcactggccatcagagaaatgcaaatcaaaaccacaacgagataccatctcacgccagttagaacggtgatcattaaaaagttaggaaacaacaggagctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacgtgcacccgtatgtttatagccgcactattcacaatagcaaagacttggaaccaacccacatgtccaacaatgatagtctggattaagaaaatgtggcacatatacaccatggaatactatgcagccataaaaaatgatgagttcatgtcctttgtagggacatggatgaaactggaaaccatcattctcagcaaactatcacagagacaaaaaaccaaacaccgcatattctcactcataggtgggaattgaacaatgagaacacatggacacaggaaggggaacatcatacaccggggcctgttgtggggtggggggaggggggagggatagcattaggagatatacctaatgctaaatgacaagttactgggtgcagcacaccaacatggcacatgtatacatatgtaactaacctgcatgttgtgcacatgtaccctaaaacttaaagtataatagtaataaaattaaaaacaacaacaacaacaacaacaaaaaaaaagaaaaacagcttctgggcccaggcagagacttgtcacaggggtggaaccacaacagagagcccccgctagagcaacactgaagcagaaacatggggttgcagcttccacagagagttcccactagggcaggaccaccactgggatgccagaactgtggagtcactggcagcatgcaaggtctgcctgagaaagcttcagataccagactgcaacccatagaagcagccacctgtgctgtacccatcaaagccacaggggcagggctgcctgaggccttagagacccaatcccaacctgcgcgcagagtcaaaagggattattcttcagctttcacatttaatgtctgctatgctgggtttaagacttgctttaagcctgttactgctttctttttgcctgtttctctcttttagaatgggaatatctctgtctgtcttatgcctgtaccaccattgtatcttgaaagttgataacttgttttgatttcagactcacggatgagattttggacttttgagtcttatccttggtgctggaatgaattaagactttgaggctatggggttagaatgaatgtatttatatgtgagaaggacatgagtttggtgagggtaaggagtagaatagtaaggcagtaattaatgagtattttgtgcctggccaacttctacttaccctataggtctcagtttaggtgtcatttcttcagggaagactttcaaaactggcttctacccccaagactaggtcaagtctgccctttaattgaggaattacagataactaataaatactagaaataatattcaatcttgttaacaatttaatgcatatgaatgcaacagatataccattttttaatcacattaggaaaaaatgtttaagataatacattgtttgcattaaggaaggtattgtcatatactgctagtgatagctatgttggtacaacttgcaagaaaagcaatttagcattatgtcttaaaaattattcatactcttttacccaatgattctacttcagggaattgatgcttacaaaataactcaaaatgaatacaaagagttattttattagcttgacagtcattattgagagcctaccgtatgccatggtttgtgctagatattagtgaagacataatccccgacctcaaggaatttataatttagcaagagatgtttatcaaagttctatttctaatagcacaaaattaaaggcgacctaaatttccaagaattggtaaatggctaaatatactttattatagccatatgagataatagtatgtcaaaatagtgtttgtaatgtggaaaaatacttacactatattattaattgtaaaaagtaggataccagatgtgatctcaactgtacacaaatagacatagaaaaaactaataaaaaacatgtcaaaaatgttaaaagtggttgttttgggtgattttcttgccctctctgtactttactgtgttttcaaagtattctataaggagtgtgttttacttttatgatcaaaaatatatttagaaaagtaagaaataaataaataaattctattttaaaaaacataatatctcatttatatgtggaatctaaagaagttgaactcatagaaggagagagtacaatgatggttaagtatgatacttgatagtgctacagactcctttttaactttctctgagacaatatgggagacaaagaaaaactcagaatgccctgggaataaataatgtttttgtattatatattctgtcagacatattcaaaagtgacatcatgtgtgttgataagatactgggatatagggagaagaaatatatatctttctaatgctaaacttgtccatttctttcttgttcctcacaggcagccctggaagcattagatgaactggatctgtttggtgtgaaaggtgggcctcaatcagttatccatgtcctggctgatgaagtacagcactgccaggtaaaatattatggaaaatggaaatagcaaattttattcttgcccagactcagatttaagcatgagctttagattaaggatagctgaatgagagacagtgcatcatctgattaattaccatgtaccaaaaatatatttaacaagcatactatactgagataagccaaatatagcatgggctataaaatagatcatagtcctgttctctagccaaaggttataaagggatcccaccatactatgtggaattatccaccactatcatatcaaagggatatggtctctctttctgagtatctccttttctaaatatataaagaaaaccagagatgatggatttgtagtattcttgttagtgtttctgaaacattctcttgttcctggttggctctaggcttagatatttggagattagactttaagtggcaaatatgtattttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctatgttcatcagggatattggcccatgggttttttgttgttcttgtgtcctcgtcagttttggtttcagggtactgctggccttgtagtgagtttggaagaattccctccccttcaatttactggagtagtttggttttagctctttaaaagtttggtagaactcagcaataaagccatccattcctggacttttcttcatcggagtacattttattactgattcagtcccattactcgttatttgtcttttcaggttttctatttcttcttggttcaatcttggtaggttgtatgtgtccagaaatgtatctgttttctctagagtttccaatttcttggcatatactttttgataatagtctctaataatcctttgtatttctgtggtatcggttataatgtctcttttttatttcttattttatttacttgggtcttttattcttagtctggctaatggtttgccaattttgtttatttaaaaaacttttcattttgttgatcttttgtattttttggccttaatttcacttatttcttgtttggtctttgttatttctttccttctattaattttgggttctgtttgttcttttctaattccttgaggttcatcattaggttgtttatttcaaatctttctactattttgatgtaggcatttattgccataaacttccttcttagtactgcttttgctgtatcccacaggttttgggatgttatgtttccattttcgtttattttaagaaattttaaaatttctttcttaatttcttcattgactcgttggtcattgaggagcatgttgtttaatttctgtgtatttgtacagtttcaaaagtttctcttgttattgatttctagttttcattgcagtcagaaaagataattgataatgatttcaattttttaaagtttgttgagacatgttttatcacctaacatatgatcaatcctggagaatgttccatgtgctaatgtattttctgtacctgttggatgaaatgccctgtaaatgtctgttaggtccatttggtctataatgtagtttaaatctggtatttctttgttgattttctgtataaatgatctatctaatgctaagagtagaatgttgaagtctcccactattattgtactggagtctaactctccttttagatctaataatatttggtttatatatctgaatgctgcaatgttaggtgcatatatatttacaattattataacctcttgctgaattgatgcttttattattatataatgaccttctttgtctctttttactttcaacttaaagcctattttatctgatataagtatagctactcctgcttgcttttggtttgtatttgcatggaacatctttttccattccttccagtttagtctatgtgtgtctttacaggtgaagtgactttcttgtaggtatcatgtgagtcttgttatccattcagccaatctacatctaaattgagaaatttaatctatttacattcaaggttattattgataaatgaggactttctcctgttattttgttaattgttttctggttgttttgtatatcctttgttcctttcttcctctcttattgtttatctttacagtttggtggttttctgtagtgataaggcttgattcctttctctttctctttctctttctctttctcctttctgtatgtgccctttctgtatgtgctcctttctgtatgtactagtgagttttatacttttgcatgttttcatgatgatagttatcatatgttcacttccagttgtagaactcccttaggcatttcttgtaaggctggtctaattctgggtatagtgttcttgcctgacaggtttttttttttttttttcagctcttagaatatatcatctcattctcttccagcctgtgagattactattgagaaatctgttgctagtctaatgaagattcccttatatgtaactttatgcttttctcttgctgtttttaaaattttctctttgtctttgacttttgacattttgactataatgcacctttgagagaacattttttggtttgaatctatttgggaactttgagtttcctggatctggatatccatatttttcccaagaattgggaatttttcagctattatttcatcagataggttttctgcacattttcccatctcttgtctttctaaaacttccataatgtgattatttgtttgctttatggtgttctgcaagtcctataggcttgtttcattcttttttattcgttttttttttgtatgcctggtttatttcaaaagatctgcctccaagttcagaaattcttctgcttgatctcatctgttgaagctcttgattgtgttttttatttcattaattgaattcttctgcgttaaagtttgttttttaaataatatctgttgaatttctcatcagatcatgaattgttttcctgattttattatctatctttattcttttatatcttgctgggtttccttaagatcataattttgagtttcttttataacatttcataaatttccttttctttgaggtctgttactagataattattacgtccctttggatgtgtcatgtttccttgccttttcatgtttcttgtgtccctgaattgatatatgcacatctggtggagcaggtacctcttccaatttatggagcagctttgatagggaaagactttcctggagatgggtcctaaggtgttggtttaggtaggatacactggctttggttctaggtggacacagttattatagtctctgtgcagtttcttgagctgtaatccacataatagatgtttgtgagtacctcaatggcctaggctgcaggagttgtgagtgtggtgggtagctttgctaggggtgggctcctgaacagactgatttccgggcctggggtgtagacatgcatgaggagaagggctgccagactgtttttctagccaaggtcataggcacatggcaggtcagctggttcagagactggtttgccaaccaggggcagggctgctgggctatttctgtgcctgggggcgtgggacttgggaactggcttgccaggggtggagccactgggctgtttctctgcccagggacatgggtccatcaggctgtttctccgtcaggctggtccagggttggctttctactatgcaggaccagagtcatggccattcctggggccaggcttcgagcagctgaggtcatggcactgcagccacctgtgtggggttggtgaaatgatggcaaagagtcaaggttggagaggtacaatggctactggcccccagagtaggggggccaactactgcactcctgcagtagctccagtttcaagatggcactgtactgcagcagctttggtcatgagaaataggaagtgcacaacatgtacttgtactctggagtaatatagttgtgtgaattctaggcagctccccaaactgggctcagcacttgggaggactgtaggattctcctatagtaaggactgcaggtgtctgggctggcaatgagggacggtgggagccttttgcttaccttttccctgcaaggggaagtccctcctgtctctgagccaatcccaataggggagatggggcagcagagccagggtgcctcgctctcctctctatgctgccatcctgggcttttctacttcacagggttcttgctgccagtcacttgctacaccacagtgctctccctcagacactccacttgaattttagttgtttattagttgttttggtccttttttgtggggaagacaagcaccaggcacctctagtcagccatcgtgctctatgttgattctttttttttttttttttttgtcagtacattccaaacatgtgtaaccaatgaacatggcctagggttttttttttgtttttttttaattggtattcacttcagtaacttcaatccacagatacaagcagtatataaccagaaagttacaagtaaacacagattatacatgcacatttctgttcacaaaggtcacatgtgcaggtacatgaattagaagcgtgcatctaggattatggccaaactgtttttaagatgcagaaatataaaattacatcttgaaaatatgaagaggtggtctacacacttcaaaaatcaaatgttgcttacaccagagatgtatgacgattacaggattcaagtgacaagcaataagatctcaaaaattagtactggtcaaagagaatgggaatatttttacgtttcactgaaaatattgactactagaatataaaatctagcaggaactcagggaaaaaaatacaaaacctaaagccaattacttaatatttcttattacctaaacaacagcatgacatttacagaaaactgcacctgcatttgaattgccaatctcattttaatgaagttctccaaaaatgaaatgcaaccaaaaaagggtcaaactccaaatgaaaagtttgcaaggctcagattaaaacatggaatgtttcagatgaaagtaataaaaatactattggttttgttctttattaaatggaatcaaatactgacatttctttgaagcttggaactgctaaatttcattttcccaaatggttctgcatttttttcttagtggtgcaagttgtcttaagtagcttacgaagtcaatctctacaaattacttctataaaacaactattcattaatcgtatgtatttttttgctataacacttaacacatgaacagacattatttctccaccaaaacaaaagagtacaatagttttcttctgtcagtattgtatttaaaaaagtttaacattaaacacaaagaaccattattttctttgaaacccttaaatcttcttgcacatcttaagttgccttcttctgtctgcattcttctgccaatttattcagaaatttatttaatttctcataatgaggaaggctgctgcaatgagtattctttgcaacttcttttgtataaaagagtgaacatagcttaccataaagccctgttttaggtattacatagtctataccaacaggaacattgggctgttatggtccaattctatactcatctgggattgtatagtcctccttgttctcatcactttggccatctgcattttcacttatgttgattcttagatgcattttactaagtgaaaaaaagccaaacctcaaagactacatactacatgattccatttacatgacactctggaaaaggcaaaactatagggaggaaaacagatcagtagttgccagaagttgggaggacagattgtctataaagatacagcactagagaattttgagggtgatggaatggttctctatggacttatgctggtggacacatgactatatgtttgtcaaaagctaaggaattgtatgccacaagaagtaaatttaaagaatcaaccagggtgtgtcaagaaagatggaattcagactgaaaaatgagtctaattacattacaaatgaatcaagtaaccacactaaaaggtatggaaaagaaaggagctgacctaagtcttggaaaacagtgttttgactagatactgcaagcctaacctaaagacaaaaataactgtatacacacactgtactctagttcaggggttagcaaattacagcctgtgggctggccatctgttgttataaatagagttttattggaacacaaccatggtgtatttacatattgtccatggctgctttcaaggtacaacagcagatctgagtaattgcaacagatgctgtatggtctgcacaatctaaaatattcactacctggtcctctatgaaaaagtttgccaacccctgctctagttgataaatttgtttctcaaaggggtactggttggcaattctgaaactactttatctgtacagtaaggttgaccaaataagtaaatatgtagtagatatagtgggtaatgagacctaggtttctcactgttacacatagggaatgggaaaagcctagaatgaaccttgtgatgttggattggagaaggtagtatcagtatgaagtgtgtatgtgtgtgtgtctgtgtgtctgtgtgtgtttaatatagggatgtgtgtcttcctatatgtgtttcctaactttgtccactgagagggcccagaggcaatgagtacacctagtgtccaaatgttggtttctaaatgtcattctcaatgaaaggacttagggctccttggagaagtggttgatttgactggggcagggaggatacaaggggagcctggagtttcatatggttctagaaaataaagaggtactcagaaaagtatggaacatgtcaaaggaacacaggaaccatctgaaaagtgcttctaatggccaaagcagaaaaaatttgaacaataaaataactatcatagtattggattataacccagagaataaatgaaatgtccataagtccatactgatataaataaataactgaaaaatgaataaataggaaagaagacagatctccctaataggagaatgtcaattaataaatgctaaaggaataaaggaaatacaaaattgccattagacaaacacaagaataacaattatttcaggagaaatctactgatggatgctaaaaccagtagacaaaagcttaagcataacgaaggtgttcgaatagtctcacagtatctcccccaaaatatttaatagttacaaatggaaaattacagtggagaaattcagcagacaccactttaaccaagtgatcagggttaacatcaccagtaataggacacattgacatcatgtactctctcatacaatgcactgagaagggcacatcacttctgtggtatccttcccaatatgcataaccgtactctgatcatgagaaaacatcaaacaaaaccaaatcgaggggcattctacaaaataactgatgaacactcttcagaagtgtcaaggtcattaaaaacaaggaaggactgaggaactgtcatagattggaggacactaaggagacatgatgactgaatgcaatatgggatcctgaattgggtcctagaacagaaaaaaggacaactgatgaaatccaaataagttatgggctttggttaatagtatcgtaccaaagttttttttttttttttttttgaaacaaagtctcactttgtcacccaggctggagtgcagtggcaggatctcggctcactgcaacctgtgtctcccaggttcaagcgattctcccacctcagcctcttgaataactgggactacggtcacgtgccaccacgcctggctaatttttgtatttttttgtaaagacaaggtttcaccacattggccaggctggtctcgaactcctgacctcaggtgcctcccgcctcagcctcccaaagtgctggggttacaggcatgagccactacacccagccaccaaggttaattttttagttttggcagatttctatggttatataagatgtgactataacggaatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaaattcagtatcattaaagggattgaacagtcaatatgaagcactttcactggtaatggaaacattgtttaaagcttagatttgatgtttgagagacattatggatttttttaaatcatcgagctcaaactcttctggtctacttcctcttccactttattttttagccttgaatttgacttcttcccctatcagtgtactaaaattatatgttctgaaacatcatcataagctcttaaatgaccaatccaatagccttttctgaatccttattctccttgacttctctatggtacctcactttttacctagccctaaattctcttgaaattcttttcctattttaattttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctctatacataatgaaaatagtttttccccattcattaaagaatatattcctaaaagtatttgaatttcacagataaagacatattgtaaatgcaacgtacagtcagttctgctataatgatacgtatgcaatctttttttgttgtcatttttaagacagggtctctcactctgttgcccagactgtagtgcagtggcgtgatcatggctcactgcagcttcgatctcctgggctcaagcagtcctcccacctcagccccctgagtcactgggactataggcatatgccaccacattcagctatttttgtttgtttgttttttgtagagacgggcctcgctgtgttgcccaggctggtctcaaactcctgggctcaagctatccctcctgcctcagcctctcaaagtgctgggattacaggcatgagccaccacacccaggccatatgcattctttaaaaatcaccatgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaatcaccatgctatgcatatttaagaaataaaaactacagggcttatgagaaaatggggtaaggagtgcagcacataaaatgtaacacatacaaaatgataggaacctaataaaaataatagtatcatggctttatacatggtaaatagttaagaaatacataaataccacaatagttaccgtactttcaccttaaaaaagacccaaagtttgcttgtgcaagtgtgtacccaagttctcaccagctcacccacctggctctcatgcccactacataatgtgcaagaggaagagaacaaaagagggattaaaaagagtgagagaaaacagagaaaaagagcataaaacagagaggaaaatttttttaaaaggctgagaggaaagaggtagaaaactgaagagagggcaaggcatgtggttgcatatccagggtggccatcagaggattgcagcttgtaagttcagtagtggtgaaaggagtgttatctgaaattggacagaaagtagtaaaaacagatgtgaataggtacagttcatcattctcctgagatatatgcatgtgtgttttgtgtattcttacatggcccagttcagctgagtacattctcagtatgaaattgtgcataaccaaacatgaaattcatgttatactcaaatttttccctaatatatcagaagcattggaacaaatttgtttacaaagaaagtgttatagcagaactatttttttttttcatcataaattacagttttgggttttgtttttttttttacattttatatattgctaagctttagcaaatggttaagcacagaacataaacttgaccataatagaacctaatttggcaggtagaaatgcagttttaagacaatacatcctcaaatctagaagctatacttaagatatacatagtggaacaagacaggcctttggaagcagactgccatggctacaccctggactcaactgtgtacttgctctgatcttccacaaatttacaacctctttgagataatttccctgtaaaaaggccttaattacacatagctcctaggatagtttttaaagttaaatgcattaaagtatgcaaaactcctagcataatatttggcctataacaagcatttagtaaataccctttcctttctattttactgggtgaataagctcctttgcaataggaccttctttggctgcaaccttctcctgggtccccaaagggactctctgtaagtctttttttcctgcctttcttttatctgcaggttcaagaatataaagaggctcttgaagcagtcctcatcaagggcaaaaatggagtcccacttctgccagagctgtacagtgttcctcctgacagggtgagtcagacagtgccataacatgtagctgatagagaagaggagcagtaccttgatcagactacctcatttgagtcaaataatttttaatcttattttgttgttctgaaagcttgtctttaggtacaggacaacataagtatgattttatttcttcaaaaataaaattttaaagcagtctcaatgatggtactgttgcacagtcagacaaggacaagaccaaaccttaatcttgagaatgatgtagagatcactaggaaaaactaggatgatgttctgtgtggactctcaagatttggtattctctatttttaggccagtaatcccggattgttttaatagatcagtcttggaaaatgaatatgtcttgttttcagactgtcattttcccaaaatgccagtcgggtgtaacattgttcctcttctccactgcaaaagagcattagacatggaagagaatagtcttccattccggtgagaatgagtagaataagctcccagcaacatcagcagcaccacctgagagcttgttagaaatagatttcaggccctacctcatacccactcaatcagaatctgcattttaacaagatcctcaggtgatctgtatgcacatcacagttggggagcactgccctagattatagtgatagtgcttcacttttcagtgcattgcatatgtagctacatagggtataaattacaatccagtccacctttttattatccagtatcttaaaccttctattattcctcatctggcctcttcatcttttcttttaggtcgatgaagaatatcagaatcctcacactgtggaccgagtccccatggggaaattgcctcacatgtggggtcagtctctatacattttaggaagcttgatggcagaggtaagaggaatcttcaaggctgtcccacttttttctgccttaagtcaccataataatcagatttttaagtagctcattaaatctgaaggatgtcttctgccttttgcactttgccttaattatagttttcctccaggtcttcagagtagggagcatggccaaccctcacaaaaagctcttgctgcctggcaaccatgtccctcctgctgcccggggctccctactttggcactgtatttggaactgctcaggccccagatctatccctttcaaaacttccctcagtgccctgcctggtgactaacagatgcatttgtgcttagctagttaattactgataatggattaagtgctaatgcttccaagcaacatgtttcattctttaactaaattaactgatatttttaggtgccatgataagtgactaggaacatcatgactttttttttctttgcttgggtttttatgtttgtttgtattttgttaagggtctctctaaatgttccttatatcagattctgttgagattgcccttaatgaggcatttgggagtttctgactttgtgtccaccttctttgtgacattttgagcctgcacagaggcattctgtttctcagaagtttttcatatcatctggcaagtctacttccccactctatgttattttgataagatataacccaggctcctagaggatcaagagtgggacttaactatcctatctgagtcagactctttgacctgtttatgtataaccactgatttttgcagctgttttgttcattttccttgtgtggctgtggccatggctgtttgattactcttagtcgacattactaaatgagtctagcaaaagtgggcagaatggtttgtttaagtaatccttacctggtgactctctcattcaattaaaataaagtaaaggcattgataaaaagaataccacagtgattggtattctttttttttctttttttaaaatttattttattttattttactttttgagacagagtttcactcttgttgcccaggctggagtgcaatggcacgatctcggctcaccacaacctccgcctcccgggttcaaatgattctcctgccttggcctcccaagtagctaggattacaggcacgcaccaccatgcctggctaattttgtatttttagtagagatggggtttctccatgttggtcaggctggtctcgaaagcccaacctcaggtgatccgccctcctcagcctcccaaagtgctgggattacaggcgtgagccactgcgcccggccagtgatttgtattcttaaggaaaaaataggtgagttcatcccatttcataaagggcagaaactcaagtcaaaagatttctgatgtgcagaaggcatagtagatacatgaacaaatgagaatacagcaggactaatggcttaaattactgataagctgtgtgatctaatcatctaatcatatgtatatccagagaagatagaggaataaccagaaaactttgtttatttataatttatacccagctgggtgcagtggctcatgcttataatcccaccactttgggaggccaaagcgggaggattgcttgagtccaggagaccagcctgggcaacataagtgagaccttgtctccatgaataaactaattagccaggcgtggtggcacacgcctgtggtcctagctacttgggaggctgaggtgggaggatcacttgagcccaggaggttgaagctgcagtgagccatgattgcaccactgcactccagcctgggtgacagagaaagaccctgtctcaaaaaaagaaaacaaattataccctacatatttataccctacctaaaaaagcatttgtggcagccaatagcaattaactctggataaaaggaattgtggtgtgaatttgggaattcaaacattttcatacagtgaaggcatttgtttcctttctacacctgtctcttgaatgttatggtgcaaggttatgggcatagggatgttgttttccctcaagtattagtttctcttttgagacttaataatctgtctttttatggtttttctttagggatttttagcccctggagaaattgatcccctgaatcgcaggttttctactgtaccgaagcccgatgttgtggttcaaggtatgtattcttattcccagtggaagaaactttatattaaaggtctggttatgggcagagatctttaggctagtaaattatgactttattctatatgttgcactttattaggcttcaaaatgtatacaatgaactttgttcggtttggtttcaaaatgctggttatcttaataataaacaaatgaatgatgttctatgtcagatgactccaaaatattatttgacacccttaaccactccttatatctggaaattattttcttttcattgtcataacattttagcctcctggttatctctgctttttctctgaccactccttctgtgctatttctactgtacttctttctttatatatccttctaatggttctgcgcttagtatttttttttttttttgagagggagtctctttctgtcacccaggctggagtgcaatggggcaatctcggctcactgcaacctccacctcctgggttcaagcaattctcttgcttcagcctcctgagtatctgggatcacagtcgcgcaccaccacgcctagctaatttttgtatttttagtagagacggggtttcaccatgttggtcaggctggtctcgaactcctgacctcgtgatctgcctgtctcggcctcccaaagtactgggattacaggcgcgagccactgcgcccggctgcacttagtcttatactcttgtctttctgtatttacactctgtattaggtagctaagcctgcctccttcatagtaaatttgcttccatggccccaactattacctctttggagaatactccaaacttttgtttttattcctaacaatttacttaaatttggggcatctactttctgcagaactctaggctgagttctataaacatgttaagaattctagtcccaatatctataaaacttctgtgccatttacatttcaaacacaaaactgacctcttttgtctccatcccatccttttcctctcctaagaaatgcaaatcgttctaccttccttatttctctcaatgatatcaccattattctagtctcttagggtagaagacttgaggtaagtttttactctctaacatcacaatccaatgtggtgttgtgaaactcctttgagatgtctccaatcacttgactttggggttggttctatatggaaaataatctcgtgtgttttctaaattttcttatacttggcatcccatgtggtcatacaggtagttcttgcttatcaatgtatatagcaaacattatataaaagtcattactcttcccttcccatgagagatcttgttctcctttgaggtttattccacctgtctatgttgatctcctggttgctctaattcattctttgaagactttgaggcctggctacagccttcctcttcctctccaaatcctgccatagaactagattttagcattgacgtcagtgcagtctaacacttcagtctcaaagttctagatatccataactctagtgacctttccttctacctatacttttagccattcactcaaaggaccaaactttaaggctctttcacttcagatacctgaaattccaatattctactctgtgatcatagtcataacattatttcaagtttctttttcttccctttacccttgtttctattttcccctagtttacccttctctacctcatggttgttcatctaaatctcccagtcaccaatgcaccataatttctattagaaccactcgaaaaatcacagccccaggtcagtgttacagtctgcattttctgatcctttacctggcctgctaaaaagctattggggaaaaaaaaagacacaaatgagcagagtggtggcactggaaatcgtggtctccaactcagctaggtttacagtgcctcctgttcatccttgttcttgttagtcagcattttcatacttctcaaccactattccacaccttctctgttttcaatccccacctctttttttcagcctaattcttggcctgctgcttcatgcctgacaatattctgatctttgtcagtgtctcagccctccccacccctacagtcttacctatccttgcctcattttctgcaatctcaggaaaagggtttcttctcctattcaaggacaagtcttccttctgatgtttgatcattatcttcttccccagcattctctagaaacttactctttcctggaatcctcaaactctcccattctgttggttctattttgtttagtctactgacatgttcatctccctctagttacactatatagcttctttctttctcatccaaacttccacttttttatcttccctttattctgcagtattttgtagtctggcttactactatgaaaatgatcttgcttaagttaccagtgacctttgtattgccaaatttggtaggtactttttaatctgtatcttactggagtatttaatctgtatcccatgtcttctatgatgccatactctcttgaatttccttcaacctagattaagcacatttctttctcattctggtcttcctcttcttctttgccccctaactattagtatttatgagaattctgtccttagcccactgctcttgcttatataaatatttctttctgttcctcagcctcctcctattccaaccttttccttcttcccttttccctctttccaccttcttacttcttccctcactctcagaagatgatctcacctcctataccatagatgaaatacaagccatgatgtaagaactcctccacttcacccccagcttttcttcatttgcccatgtcttttatgttggcattttccaaggttatattctaagtccgcttctccttttctctatgtattctccttgacccatctcatctctttctatgctaatgactcctgaatctgtatcagcttcctttaaggtagcctcacttgggtgtctcacttgccctgtaaatttattcaacatgtctaaaattattcagctataccctcctagtactacatcacccatacctgcttttcctcctatatgcctgtgtcattaaatgacacaccatcctcccagttacacaagtaaatacctagggaatcctctctctcatctcctacattcaacagttaacaagttctggctgctttatttcctaaataattctgagatccatccagttttctccagtaccaatatcttgatcctaatggaggtagtcaacatctcttccttgcattactgtagtaactttttttttttttttgagatggagtcactctgtcgcctaggctggagtgcagtggcgcaatctcagctcactgcaacctctgcctcctgggttcaagcaattctcctgcctcagcctccggagtagctgggattacaggcacgcacctccacacctggctaattttttttatttttagtagaaatgaggtttcaccatgttggccaggctggtctcgaactcctgacttcaggtgatccacccacctctgcctcccaaagtgctgtgattacaggtgtaagccacagcgcctggccctgtagtaactttttagctggtctctctgtcttactacagtctatcagtttattctctgtcaatctgaatgtactatttttaaggtacaggtattaatatggtattcctctgattatgcctctacaagggcttcccattggcagtctccttaatatgacttacaagaccctttagatctagccccgaccccatctccagcttcattttttatcactgcccctttatgctacatgttcctgttataaagggctttttataattcctagctctgccttgttttctgttcccttgagcctttgcccatgctatttcttctgtctggaacaatttcttccttacctttaccatatcctgttgcaggttaacttctattcaggcctctaggaggactctatagccgtctcattttttccatgtagggatcatgtccttaacatatggcagtgcctagcacataagaggcactaaataagaattttctaaatattttataaaacaaaaaaatgagttgcttgggttgaaggtactcctggggccccagagtattgttcacttgactgtctttcagtcccctctactcttacaaccaattcccatgaagaatcctaaggctcagtagaaagcagtttggaaagcatggcccaaagatgaaatacaaaatccttcaagtgatgcatatgcccttcacgatgctctaactcctgtctatctttccagatccatttcttttgccactatgcaaggtatattatgctacagcaatattgaagtgtatgtggttcttcccacctccctctatacatgcagccatgctgtttttcatctctgtgcttgataagttcattctggactctcttcctagaagggctatatccttcctaatcccttgtttctcctagctaacttattcattatttcaaactcagtttaggcatcaacactttgcagaagcctttcctgatactactcctcccaaccccacactacctaggtgtcactcctggatggtctcataaagttttgtgcacttatctctatttacctagcaggtcattttacaatccatgtgtatgccacttcggttacactgtgagctccttgagggaaagactaatttatccatttctgtatccctagtgactagcatagcacctcatccattgaggtacttaataaatgtttactaatgaatgaatgaattgccaaatgttttttcctggactgtcctcagccccctatcattcttcctctgcatatttttccctgaagaatctcttttattttcatgttttcagttagaagtaatcaagatggtgttatgtccaggggactctgtgatcaacatatcctgctatcctggcccagacaacagcagcccattagcatgaggttcccaagatagaaaaatacacaaaggataatggcaaaggaaggcaaagtagcactttgttaactaagcctttgcttcaaaaactcaatgtagaaaataatggtaagccaagcagtgcattctttttcctgtgaacaatccatcacatctaccagcactagaggagcaggagtagagggcacatttgccacagttgcttagtgtcaagacagctaaagcctcaattggattactggcccccagccaggtgtctgttccatatagcgaaagtgaaaaaagaatcaggaagctggcctagcctcctctcttgtagttgggcttcctacttcagtgacaggagtataagaggaagaaaagagagctgtccaggcttgtcaggctctgaatctagagaagtttcatcccccatctctccccagcacccgctacctgctgcctaaaaaacacacagtttcaactataataccttctatatgttgatgactcaaattgttatccccaattcaccatgccttctatcattctctagctataggcaactcttgtcattagggtgttctttattacccccacatacctggctctgaccttaggtttactgatacaaaagaactcggggaatcagtttttaccaaagctataccaaatctcatgatggatttttctcccatttaaacatggaatcttagatataaaaagagtgtggtattctctaggagcacataagtatttaggcaaaaagcaaaatctaatgctctagtcttgagatcttttcattttccttttccttttagataatattatttagcatgatacttattttatcaaagttcctcaataactgttcatttcctcccatttcctttttttctctttaaaagaaattatataacttgagagattgttaagttgctattgaaataaaattttctgttgacctcatcttctttgtctcctctagtctccattctagctgaaacagaagaaatcaagaccattttgaaggacaagggaatttacgtggagaccattgctgaggtataccccatcagagtacaaccagctcgtattctcagccacatttattccagcctaggtaaggagattggctagcctgctagaatcaaagcattattcattataggctggtttccatccttttttcttcttcatgattgtgtattgctttattaagctggatctgagaaggaatttagagtctctagaatccaattttcttaccttctctattctgagcaggcctgataattttaggtgtgttttatgaaccctttgggtacataaggcatgactattatcagccaatattgtatctttattccaagtgtgtgcttaaataacatgttctctcctttcttggagcctatacctctttttcaaatacttgcttattttatatggaatgatagccaaggaacttgtttttaggtcttttatactttgtcatttaatgaactagttgataatataaaagattccttaatataatacttatttttaattagtacttatttttttaattaattcacatattaaacttagtgatagattttttgcattaaacaaattactatattgttatctaaaagaaattctaaactactcttgtggaagactgaataatgactccccaaagatatacaagtcctaattcctggaacctataaaccttaacttatatggccaaatggactcatttgagatagggagcttatcctggattacccaggtggtccctaaatgtaatcacaagtgtccttataaaaggaatcagaggaagaccagactataaaagtaggagatgtgacaacagaagcaagagattatagtgataaggctatgagccaaggaatgcccacatcatctagaagctggaagaggcaaggaatagattcttccctggagcctccagaaggaatcaaccctgctgacactttggttttgattttagtcccataatgctcattttggactcatgatgccaagaactgtagaagtataaatctgtgttgttttaagccaccaagtttgtggtaatttgttatagaaccaatagaaaagtaatacaatcttaaaccacaagggagtagatttgtaaaagattggatcttaggtagtggattgccacttacaaacccagaagttagtttgtatatgtgtgtgcgcgcgtgtgtgtgtgtgcgtgtatgtgtgtatgtgtacttttttatcacccaagaatggtatgttagtaattacagttaaggcaagtattcccagcttaaaaccagtctccttcccttttctctggcacgtaactccagtcacttaatttctttgtctaaattgagagggaatcaaccaaggaggaaaggaccaagagtcagagctgacttttgtctgtctctaggaacatatatttaatgccaacaaggcttgaactccttgcattccggagctattaacatggcttctggctttaggagtatatggatttctttcttccatcttagctatgatgtaggaatgtccctttcctaaaaattcaaatataacatgattagaattttctaaagaaactttgctttaaaaagataatgaaaaactaaaatatatacacaaagaaattaacaaatttgttgaatatgtctcagatcctaataaatttctaaaatctagccacaaattagcttgaatattataaaatactcctggttccctctatttactcaaccctaactgaggtaaataccaagtcaaggctcctgaaacttctgaggctgatttgggtggatgctttgctaggtgggttacatacctcaccccttcccagaacctgcttcctgtttttattttttttggccattccctgtcaccccagacctataatgcacttctagtctccagatactagtccactagcactaaatcccttgagataaggaaggtatttccctatttagccaacatcttacccacttgagtactagttgatcttacagtcaccttctttgtaactcttagaagtctctgcagtaatgggtttatgcaagtcctgttggtgattttgacctgattctctctggctctcactcaaaagttaataggttaattttacccattgcctcattgcatctattattctaaatcggcatatcttactgggaaacaggtaacttctaagctctgggccatcatttatggaatctgcctgcctcacatcaggtctctccaacaaatagaagcaatctccttactatttactttttcaaaacctagactccatcttgggcctcttactaagttcttattttctagccaaaggaaataaaaacttaatgatgatcaaacattccaaggactcaagtgacaagtggacatttatcttcctgatacgttctttcatttgcttcattcattcattgataagcatttattgctcacttattatgtaccaggcactgggctagatgctatggaagacatagccatgcaactaaataatcacagtacaatcttataaatgctatgaccacggtgttacatataaaacacagaagaaaggggatagatttgcctggggaagtcaggaaaagcgtgatagatgaggcaacatctgatgacttatcagtcagatgagtgactattcaaaattctattattgcaacagtttcacaataaaaaaattgccctaagggtacgtcaaatgacaaccataattccatgaaggaaaaagggctatttctttaacaggtgtatttgtttatatatgttaactaaacggagttctctttctcccctcaaatgctcagtatttcattgtcagttccaaaacattttttttatttttttaaattatgagattaatcaactttgtgaaagtaagaacttaaaatattaagttcaaatctttatgtaatgctaattcttttctaatcttagtgcatatagatacattttaatagttatctttaacatgcctatattcacttgtgttctgtttgttttcacttattctctcgtgatgcatttccacatattgaaatagctatatagtatttcatcaaatcaaagtaattgtttcctgattattagctgaatattttcaagaatttttatccttctataaatgcctttgtatagaccactgttttcttaattgtatattctcagtaaagggattctggataagcttgtgaacagctttttagctcttgttacatgttgccagatgattatttacaaagacgaactaattcatagtgacataactaagatataaaatatacctttcttttttactaccccactaacattggagttttatttatttttgttagataagtaggttttagtatgtataaattattttaattttctatctttaattcccagggacctgtacgtttttctatttttgctttacctctttttttgaaactatgtgtctacaattgcttgcttatctaatagggtctgcacatttctgtatatatttatcaattatttatattttatggtaagcttttatcagtgagacttatatatatttcctagtctgttactttcttttagataattattttcttgcctgtgtacaaatctttaaatattagatacatccattttatcagatatatttttcagtccttcaagaattatgaatttatctcctaattctatctgaataggtatgctattctggttctctccaaatttcataagttgtaagttatctgattacaaattggtatgtatgcattgactgcagggaactggaaaacagacaagcacaaaggaaaaagataacaatcgcctgtaattccaccactcagaggaagccaccttttattttggcatatttgtttccaatcattttaaataaaataagtacaaacatgtttttagaaaaatgatatcattaagaatggattttgcattctgtttttcttgaaaaataacagtatatgataaactctgttacattttggtaagtagccacctacaatccagtttgatagctgtattaacgtaatttcttcaaaagttattttcataaatagcctttttctgttaattttgcaaatcgtctccttatattcttttgccatttttctactggatacttgttgatttcttactgatttccatgaggtatttttaaatatattagggatactgacactttctcttccacatgttattgaaatattttgctattttgttatttgccctttaattttgtgctgcttttcatgtatagaagttttatattttatgtagtaaaattttctctttttttggattctttccttgctgttacacttagaaagatagtcccatccctaggtcaaatacattttcactgcattttctttgttatttatggttacaattttacatttaagtcttaggctataatattaattttagtttatccaatgaggtaaaaatctgactttttgccaagtaaccaatcgttccagcactactgattgaatagttcatatataggttgttttgaagttccacctttataatttactgtacatgcatatactcactcacatgtgtggatacttttaatcttactttttggtgctgctgatcactgtttcttctttcctagtactatattttttaagttatcatagtttcaacctcaccaatgattgtgaaaatgtaagataaaagaatagtgctatgtaattttttgcccatcaattttacaaaaaaaaggtaagattgccaatatccagtgctgatgaatatgtggagatgtggacactctcagcactcctggtagtgtaaattagaggcaggtaggcattacctataaaaaaatgtaatgcacatgtctttgaccaacaaccttacttctaggaatctacccttttctttttctttttctccccccaagatggagtcttgctcttgttgcccaggctggctggagtgcagtggcgcgatctcggctcactgcaaccaccgcctcccaggttcagctgattctcctgcctcagccttccaagtagctgggattacaggtgcctgccaccatgcctggctaatttttgtatttttagtagagacggggtttcaccatgttggccaggctggtctcgaactcctgaccttgtgatctgcccaccttggcctccttcccaaagtgctggaattacaggcgtgaaccactgcacccagcccagaatctatcctatataacattcgtacaagtacacaagggcatatattcaaggatgttcactacattataatctgtggtggcaaaacaacaattagaagtactataatgtgtataaacaagaatggtagaattatgtatattgtatcatagctaaaaaggtagactttcagcttccagctgtgatgaaatagcttgtattgggctgtcatactaacaataactggaatggctgaattttaaaaatgaaggtgagtgaaggcttcagagagtaattacaacagccagaacttgagaaactaaaaccttggacagaagggacactcaaagaataaactcactattctctgtgcagtttacctttgaggcatttgctgattcttaagttttgcttgcatgaagtaaggggccaagaaactaagcaggaagtctcactgttctacggagacaaaaattgcatttcaggaccttcctatgtggaaggggctgtgataaacaccttgggctttcagttgaaacccctaaagaatggactacaccttaggagtaaggaaaaaccataaatagacgagttcttagaaagcctcaaatacaaatcctaaaacacaatcttcttaattcctgattgggctaagaagatctgcttatactgtatctgcctactaaaataaactgaatcttctctggagggaaataatgtcatccagagcctctacaattctttatacaccgtattcagcattgaaaaaagaagacatgacttagaaaaccatgacttgttattaattggtaaattaataaaattaataaaagacaaaagaaaaaaataaaacagacacccagacttctattcaacatagcttttttttttttttttttgagagaagctctcactgtgttgcccaggctggtcacaaactcttgcgctcaagggatcctcccaccttagtctctgggacaacaggcacacaccatcacagtcggccatcattggaagttctagccagagcagttagacaagaaaaagatataaaagacatccaaattggcaaagaaaaattaaaatggtctccattcacacatgacatggttttatttaaaaaacaaaaacaaaaacaaaaaaaacctgtgagaactaataaacaaattcagcaaacttataggatacagaatcagcacacaaaagtcagttacatttttatacactaaaaatgaacaatttgacaaggaaattaagaaaacagttccatttataatagcatcaaaaagaataaaatacttaagaataggcttaaccaaagaggtgaaagacttgtacactgaaaatggaaaaacattgctaaaagaaatagagaggagacaaataaatggaaagacatgctgtctttgtgggttagaagacataatattgttaagataccagtacaacccaaagctatcaacagattctatgcaagccctatcaagagcccaaatgatgatttctgtaaaatagaaaaattgttctaaaatttatatggaatctcaagggaccctgaatagccaacatgaggatgtggagacatgaaaactcttgtgtactgtggatgggaatgtaaaatgtgtcagcccctatggaaaacagtatggcagtccctcaaacaaattaaacatagaattactatataatccagcaattacacttctgagtatatatccaaaagaagtaaaaataggaacttgaacattttctacatcaatgtgcagcattgcccacaatagccaaaaagtggaaacaacccaaatgtccatcaatgaatggataaacaatatgcaatgtatacacaaaatgtatacccaaaatggaatattattaagccttaaaaaggaaggagattctgacatatgctacacatagatgaactttgaagactatgctaaatgaaataagctagttacaaaaggaaagatattgtattattccatttatatgagataccgaattcatagagatacaaagtagaacagtggttgccagaggctgggaagcagaggacatgaaaagttacttactgttcaataaatagagtttcagtctgggaagatgaaagagttttggagatagttggtggtgatgtttgcacaatgatgtaaatgtacttaatgccactgaacttaaggttattaaaatggtaaatggtaaattttatgttgtgtatattttgcagtattaaatagaaacaaaaagtaaggagtagtgggaaaacctggttgtgacatcaatctcaggtaaaatgtgtgctttactgcatggaccctggaatatgaccaaggctttaacaattctctgatgctagccccctaagagtaaagcaacactaaaactggcatatttgataagtataacacttacgtaaagcaaatgaaaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctacatgataataacaaacctgattgtatgtgtttatggggaggagaaactattttctggaaagaaagcttaaactccccatttgtcatcttacatttgaaatagtgcagctgaggtaggtataaacaaaagagtaatggatcatagattctatttctgactttgtcatttgctagccatatgatttcactaatccacgtatcatctcttagccttatttttcatctattaaaagaagaaaagccctcactggggggttacaggattaaataaaattatatacttaaaaatacttcgtaaactgcagcataccgtaaaaatgtcagaaattattatatgtgccagttaaccccagatactttggaatgtattagacattaaatgtgggggtatcattgccctgtgacatcttggatactcttctgaatatatgagtagtttaaaatattacttgataattgtgagagtaaattaatctaatctattatttttatttgtctcagtttatagaccagcaacagttctacctggctctggacaacaagatgatagtggaaatgcttagaacagacctctcctacctctgtagccgctggcggatgacaggccagcccaccatcaccttccccatctcacacagcatgcttggtaagggctgcatgaggcaaggaacgaatgtattttggaaataagtcatagatttagcccttcaacatcttgttgtttctagagagctacttcttataatttattctttcagcagtatttattggctcctattttatgccaagcacttttctaagcactggggacacatggagtgaataaggcagatgaggtttccgttctcatggagcttatgctttagaaggtgaagacagactatatgtaatacataaatcaacatacaagagtaatttcagagctataattgaatagttttcagatagtttgagagctataattcaaaaaatgtagtggaggataatttaaaacttggttggtggttactttagataattagtttctaggtcaattttcagaaattttattcatacaattatttttaaagacagtaatactgtatctgcatatttcttactctagtggtacatcaagattttatagataatttcccaggctgcttcttccaaagcctaacggaagctgtaaaatctagtaggggaaaaagccaaaaggcttttggcttacgtttcctcttttttttttttttttgactggatttcctgacattgcttacttgaaactgggtgaaaggctttattattctctcagttcctggaggactagagccaatactgaagcgactgcttcctttctgtgtttctcctgttgcttccaaagacctgtttgtactgccaaagtatatagaattccttttcattaaagaaaaatcccttattattaatcattcaaaatccagacagactgttagggattttggtcacatctcaaaagtgcttcaatatcacaggatttgaggaagtagggtagtctttcttctctttgtctttcttcattacttaagacagttaacacaagtacccatttaaaaactactatatttgcagaattgtcttcagaaagtataaagtctaattggagacgaaaagctaatatgcaagaatgatagaaacaacttaagacaatatataaagaattactaaaccattaggtcagtattttacagtgaaggagatccagttgacaaagaaaatttctcaactgaggtaggacttaaccaggctttttggaatggatagtattcagatgacaggagagcagaaggaaaggtactataagtgaggaggaaaataccatgagtgagccctagaggcaagaatgaacttgacctgtgagaggagaatgaagttctcctgaatagagtggagtttgtgtgttggagtataattataagcaaaatgggaaaagtaaggtagggttcaataatgaagaccttgaaaataagcaaagatatttaatatagatttttctcagaagtctgaaactatcaaaaggttttgagcaaggagtaatatgataaaaatgatgtttggggactattggtgacagtacacattgtagtgaggagagactgatgtcaaagaaactaatccacatatgaggtgaagagaaagtacactggattggaggtaataaaagtagaatgaaaaagaaagatatgagtcattttaagcaacacccaactcagatattggataactagatataaggtatgaattaagatagctataacaaaataccaaaaagttggtaatttataaacaatagaattttattttgtactattctgggagctaggaagtccaagatcaaggtgctgacaggtttggtgtctgggaaggacctgaagtctctccttctaagatggtgccttgttgcttcatcctctgcagcagacacacatgtgttcttacattgtagaagggacagaaaagaagcaaacccactctcttaagcccttttataagggccccgatcccatccatgatggctgcacactcatgacttaatcacactagatggcctacttcttaatgctatcacattggtgattaagtttcaacaaacgaatttgggggcacattcagatcatagcactaggtaaatgttgctgcattgatagaatcagagacattttatatgaagaagccagttataaagggacatgaatttgtagtgacaaagagatttcagaattgaaatacctgagagttgggatgagatacatagccacagcttgggaagcagaataaaactaaagatctaggcttaaatcaagcatttttggtacttgatatgtggtcacataacaaaaacaacaataacaatagcaataataactgtaatatttactgaatactttctctgtgccaggcactgagctaagtgttttcaattaattattttgaaatctctacaacactcttattcaggcaggtactcattatccaaagtcacaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattagttaaattctcatattacagacaaagattcctgtaatacataaaagagcaaaaataatacataaatggcatccaggtggatgctatttacaatagatatccctaaaataaaatcataaaaaaagatggaagaaaagaatatgtaaagatatatcatgtaaatgctgacaagaaagcagtggtcgcagtattaatatcaaaaatagcaaataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtatatataactatgtatccaaaaaggcagaacacacaaagaatgtttatggttaaaaagtagaaatcatacaaacgatattgccagatacgtgacataaaactaattaacacagaatagttaaaaagaatctaactataaaggaattatattttttcccaaataattattagattaaagagaaagtcaaatttgaaattatatgcttcttagaaatgaaaaatgataccactacttataatttatgagatttggtcaaaatcatatttagaaaatttcatatccttaaatacttctacttttaaaaagtgacttttagttttgagacaagatggcatagactcacttctccctattcctcctgctaagtgcagctaaaaatccttgacatatataaaacaaacataagaaaactctgaaagttggaaaccaggcagatcagctagagactttaagacctgaagaacagcagagcagtaaatatcctgggccttatatgtcctggactggaagctagagaagctgacatctcagaaatacaaaaagaaaaaaaaaaaaggaaaaacaggtttttttaaagacccaaggaaaatctgctttgtctagctgaaggaacaggaaaggagcaacctagagagacagaaaacttttagaccctattttactaggccccacttatgcccctgtcagcagagactgagtggggactctagacttccacgcttgcacagctctgaagaggcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagtaaaaaaaaaaaaaaaaaaaaaaacctgaaaaaatatgaacagagcctcaaagacctgtaggactaataacaaaagatttaacattttttaacattcacgttaaaaagatctaacattcatgttataaaagtttcagaaagaggagaaaaagtatgagagaaaatcagaaaaagcattccaactaataatgactgaaaaattggtaaaagacataaacctacaaattttttaaaaaatgagaaaatcttaaacatggtaaaatccatgtcaaaacacataataataaagttcttgaacattaaagaagaaatatcttgaaagtggccagaaagaaacaataccatttctataagcaacaaacagaatgacagcaaatttatcatcagaaaccatggacaccagagggaagtgacacaacattttttaagtactgaaaaaaaaaagaattttaaaccaagaattttgccctatccagtgtacttcaagaataaaaggaaaaaagacattctcagatgtaggaaagctaagtgaatttgtcagcaggagatctgccctaaaagaatggtttgaagaaagttcttgaaacagaaaggaaataataatagatggaatcttgaaacatcaaaaagaaaaaataaaaataggagtgaaaatatgagtaaatacaatagactttctccacttcaattttccctttctttctctctctctctctctctctctctcccccacccccgctctttttctttttctttttctttttctttttctttttcagagtctctctctgtcacccagcctggagtgcaatggcacaatctcagctcactgcaatctccagcttccgggttcaagtgattctcctacctcagcctccccagtagctgggattacaggcatgcaccaccatgcccggctaagtttttgtattttttttagtagagacggggtttcgccatgttggccaggctggtcccgaactccttccacttcaattttctaaattatgcttgataagcattgcttaatatagttctcaaagtatgtagaagaaatattcaaggcaagtatattataaatggggaaaagtaaggaccttaatgggagataagattctatacatcactttaattggtataatgttgacactagtaaagagtgatatatgcatcatgtttgtatatataagacaatgcctggagtaaccactaagaaacctatagaaggagataacagtcaaacccagtataggtaaatcaaaatggcattctaaaaaatgtaaaagtaacccataagaaggcaggaagaagaaaatagacaaatgaagaacagaggtacaaatagaaaacaataaaatggcaaacttaatcctaacatatcaataattactttaaatagcctaaatacatcagttcaaatatcacaatatacgtagactgaaaagaaaaggaaggaaaaagatataccatgtaaacattaattttaaaaagcagaagtagctacattaatatctggtaaagtagaactcagagtaaagaaaaaaacaggtagtaaaagtgttaggaaagacaaaggagatatagcaacagaaatagaggagactttaaacactgtaaaagaataccaactacaattttgtacatctagataaaattgacagattttctagaaaagtaagaatacaagtataagctgaataggaacacttataaaagtgtatgagaaaaactataaaactattgaagacaataaaatattttaattagtagagaggtacaccatgttcctagacataaatagttaatattgagaaattacccactttcattatatcaattcaggcaattcccaataataataaaaacataaatttttatgaacaagctgaaccttgatttcatatgtaagagaaaatgtaaatgaataaccagatttttaaaaagaaagtgaaagatccattgtaattaaaacaatgatgaagatagaatttcaaatagagacaaaatttaatataaatacatttgggaaaataattcatttaggcttgctactttactttttttgcaaaaatacattctaaatagattaaagagctaaacataaacaataaacctgtgagagtcttagaaaaaaatatgggaggttgggcagggtggctcaaacctataatcccagcactttgggaggctgaggcgggaggatacttgaggtcaggagtttgagagcagcctggccaacatggtgaaaccccatctctactaaaaatacagccaggtgtggtggcacgcgcctgtagtcccagttacttgggaggctgaggcaggagaatcacttgaacccgggaggcggaggttgcagtgagccgagattgcaccactgcactccagcctgcatgacagaggcagactccatttgaaaaaaaaaaatatatatatatatatttatatgggaatatatatatatatatatatgggaatatttttgttatcttaggttgaagagagctgtcctttgcaagacacaaaaataaaatattgtcagattttgaaacatgaaaatgaaatcttttatatcaaaagcactgtggatgcggttgaaagaaaaataataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacgaaatcaggagattgagaccatcctggctaacacagtgaaaccccgtctctactaaaaaaaacaaaaaaaatacaaaaaattagccaggcgtggtggcgggcgcctgtagtcccagctactcgggaggctgaggccggagaatggcgtgaacccgggaggcggagcttgcagtgagccgagatcaagccattgcaccccagcctaggtaacagagcgagactctgtctcaaaaaaaaaaaaaaaaaaaaaaaagtgtaggaaaaagtctttctatactgttggtggaaatataattggcacaactcttatagtgggtaatttggcagtctctgtaaatttacttagtaagtgtttcatttgtcctaatagttctacttgtaagaatttaacctaaggatataatagaataagtgcatcaagatgtaggtacaatggtcttcattacagtgttgattataatataaaacagtctaaatttagtaagaattatttttagctattacaaaggtaaagttagaaagcagatcatgaaagagtatatgtagtatgattacttccacataaaatcaggtaattgttagctttctagatattttttatgcctatacacagacatatgtgccaaggttctttatatgagataatgtgtataaaatgtttagcacagtgcttggcacataacattcaacaagtagtggctactggtattatcagcattcagtagtcattcagtgttctgccatcagacactgtgctaagtacttctgacaaataagataatgctgacaaataagataatgcctttgaggaaatctatcagtcatcatcccttaccatttacccattcttaagtgttgttggctctcagatgaattgttaaaatcaggatggtcaatgaggagtgtctcatttgtattgtaaccaccagaatgttgatttgaaataattacaagatttctccctacttcagagttaaaaccacaaagattgttttaaaattctgttcatttcaagatgaagatggaacaagcttgaattcaagtatcctggcagcactccgaaaaatgcaagatgggtattttggtggggcaaggtaagtgacctctatacactctttagtgaaatgaaatgaaattaaggggctggatatagtagtggcatacctgtgatgcctttctgtgtatgatagtccccccttatctacaatttgactccgatatttcagttacccgtggtcaacctgtagtctgcaaataggtgagtacagtacaataagatattttgagacagagagagagactacgttcacataacttttattatagtatattgttataattgttctatttcattattattttgagctcttactatgcttaatttataaattaaactatatcataggtatgtatgtataagaaaaaacacagtatatatataaggttcagtactatctgcagtttcaggaatccacaagggggtcttggaacatatcctgcaggagtaagcgggggctaactgtatcttcgataacataatcccatcctacttagaggagtttgatagattgaatcaaggaatttaatgttgtagaggaaggttggaagtttttcctaccctgttctttgcctagatctcaaaggatcagaaaacctgttttgttttgtttttttaatgcctactggattatttgattccagctgcttttcttttctttttccacttaagtttttattttgaaaaatttccagcttacagaaatttgcaagaatactactgaacacccatataccctttctcaagattcacctgttattaacattttgtcccactgtgcattctctatttcttcccttccctcccttcctgcctttccccccttcctttctctcttcctccctacatcctcccatacacatacatatgcatatacacacacacacgtacatactacatatactatgtgttttatatatatatacatatatatacacacatgtacacacatgcttttttgctaaaataattagccatagacatcataactcttcaaccctaaatacttaagttttctttgttttgtctaggaacaagtgcattcttacatataactataatataatcatcacacttagtttgggaggccaaggggggcagatcacttgaagccaggagttcaagaccagcctggccaacatggcaaaaacctctctctacaaaaaatacaaaaattagccaggcgtgttggtgcatacctgtaatcctagctacttgggaggctgagacatgagaatctcttgaacctgggaggcggaagttgcagtgagccaggattgtgccactgcactccagcctgggagactgtggaaagcagtttggagatttctcaaacaacttaaaatagaactaccattctaccctgcaatcccattactggatatatatccaaaagaatataaatcattataccatagagacacatgcatatgttcatcacagcactagacacaatagcaaagataaagatgggcatcaacctagatgcccacctatggtggacttgttaaaggaaatgtggtatataatgcaccatggaatactacagtgccataaaaaagaacaaaatcatgtcctttgcagcaacatgaattcatatagaggccattatcctaagcaaattaacacaggaacagaaaaccaaataccacataccacatgttctctcttataagtgggaactaaacattgagtagacatggacacaaaaaaggaaacaatagacaccaggaccttcttgaggatggagggcgagaggtaggtgaggattgcaaactacctattggatactgtgcttactatgggtgatgaaatagtttgtacaccaaacccctgtgacatgcagtttacccatgtaacaaatctgcacatgtacccctgagcctaaaattaaagttggaaataaataaataaataaagtagaaggagaaataagaacagttacccaattatcccaataatgttttatcatagctgttttcccaccaatccaggatccaatcaaagatcacatgttagcagttagttgttatatctctttggtatcttttaatctagaagagttctccagccttttgtcaatctttcatgagagttttcattacatttttgaagaatgcaggtcagttattttgcagaacatctcacaatttggatttggctggttgtttctcattattagattcaggctacatgtttttggcaggaatactacctgtgtgatgttgggtccttgttttaagttaggatctttaagatggagagcaccccttcaatggttaggagaggcacaagatggaaataaagattttattacttacaggtcctgcaggtgaggtacacagaatacctggaggccacacacactgaggtcagggagcatgtggagagagaaaaagagagacccatgggccaatgcctttattgaggtccagggcattatccaaacagatattccttggggagttttaattggtgggtttaaagcaagtaggcatgacttcctggaggtcacactgtgactgagaggtggtcactgtggcatattggcatagttcatgtaggatgtgaggatcagtgaggctagtcaaatagatcatatttagctgtcccttagggaggtggttaccaggaggaagttgtataaggcagatatgtggactgaccacagtgaggaactgagggaggtgtagaactggaaactgtcaaagattcctgaactctgcttctggtatgagaaagttaagcttatattcaaaagagatgccagggaaacatacaattataagaatttactacagtctctttcagtgcatcatatcagaggcacatgagatttgtttgtgacattattgggtgatgataaccttgatcacttggttaaagtgttcaacctggtatctgccaggtttctgcatatcctttctccaacagtctttgatcaaatcgtattagcttccgttgatccttgcgtgaattcacttattactattggagttattaaatggtgtttctatcattctgtgtacatttattggttgaaattcttatgttaaaaaaaagagctttcccttccccccttttattttgtagtttagtatcagcacagattcatagattattattttattcaatatgccatgatccatttctgttattatttcaatattttaattatccaaggtgtggccattgatagccccttcaagttggcctctttagaaatttggtaatgctgactttgcttttgggttttgtaattgtcttcataagtaggagacgatatggcttacagtctactataatttacagaattgtcaagtaccatcctttatgttcaaatgacctttgggtatttttttaatgaagtgatgggtttgtgatgatttatcttcattctctccaggcttctccagtagccaatgcaaatttttaccagatgtttggcatagttagcaacgtaatatatggcagtagaagagagcaaaactggtctgctggtggattgttaatccataattgtaacctttattaatacagtcccctaaccatttaagatgtacaccatgcctaggagtgctgtaaaattttatttttataaaatttatattaatgtatgcacattagtaatcccccaacaaaacatgttaggtgtccttttatcactaagattgtgttgtttaaaaaggatcacccctgattttctgttttctatcctcctctaatttttagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatggtaaggaggcttcataaagcactggcctggctggacaaaactacaaaatattgtttagcaccatccttaataatttatgctgccagcagtctcacagtgttctatcctcactctagatctctacttttgtttggctttacttttcctccctctacttacctttggtttctggtctaatattcctgcggtaattgtggagtatggagttggacagtcccttactaagattggggaagattcctctcccaggcatttgaagtggctggtgattttgacatgggaagaagcagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaaaaaataaatttgctgccctcagtgaggtcagccagcacaatctcatacaataggacaacacattagcagtcagaaggactattttcttttttgggcccgacatttactcactaagcaccacttcattcattctgtgtttgtttttgtaagatctaaaacagttgaatttctttgttggaaaagtacattaaatacaaggctatttactgttatcagtaataacaaaagtcatgatgtcttggcataaaatactttgaaaattaaatgagaagatcatatattgagattgtttgctcttctatgggtagttgtgatttttatctgtagtactcattccattggattactaaaatatatatttctaatgatacgtgttactgaatttgacattatggcattctgagtcactttcctagttccgggtttactcatcagtgttctcaaaatgaatgtatttattgcttgccagcccttctgtgggtaaagagcttctctccatattcttcataatcctccactcaagtctctagattgtattcaaggttacaatctttgtcattaggatgtcactgaatatgagctccattcttacagctctactagttcgcattagtcacatcagagcacagaaagacatctggagagatcagtaaatatcatcaaaaaccagaagactcatgactgatacagcagactttggtatcgatctgaatagtgtgtttttctaactataaaccttgtgaatattcatgtaaagtctgaaatattaagcttccacaggatatatgtatgtttttctttccattacccatactcagagataatgttatagaaggtatatgggagaaggggagcccaagaagatagggaccatatccatcctcttcaccactgaaatgtcagcacctagtacactgcctggtacatagcagccaacaaatatttgctgagtaaacaaacgaggtgactaagaagatttttgccctttcctggcccttcctcaccaaagtcccctcacattagtgtgacctgaagctccctgttctgttcctcctccatccctgccaccattactatcacatgcacacacacaaatacacagattgctaaatgcttgctccaatgtaaaacaagctcatactgctttcaagaaccctgaccttgtctcagcaagttgaagaggaggtggatcctagtaaatggccatggtcactggatcttaaagtgatgaggttatatcatgatcacaagcttttcctccatgagctaaaaacaacctacttctggtgctgtgttgtgagcacaggagccaatcattctctttgctggggtagattgtaaagtaactaaaatattttcattcttttctcttccccctccccccactaaccttgcagctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagagtgagtaatgccgtgactcaccagagtcaggcacaggatgacgtgaagcccaggataggggcgggcattgattacaatgtaagcaggaactttagttttcttcactgctttatcccccgcatctcagacagcacctagaacatattagacactcaaatatttgtaaaatgagtgaattgtgtatagttatgctgcaggtagtgctatgtagtctggtttaactggtaacatggtaagaagaggcagaacaagagacatggagcatattcaactataacattaaagtttgaaatggtagaaagggtttttcctttgggaaaattacttctatggaattttcttgttgttccagcaatgtagagctgttttgtcaaatataatactcattctttacaactttgccattcttctccccatggccactaccctccttcagttgtattcacagtggagggtgtcttctgccacacattgccaggagtagtcatagttcctaagagtgttcaatgtctttatagtagctggatatgaaaggagagaagggctccttggccacacctagaagacctgaatgttaacattttacagatgaggagaatgactgagatgcatgctcttgctgtctaaaactttattgaccattactaaccaaatacattaaacatgaacattgggaatcatttaacatttataatagggaaaagctcagcataccctctgagtatgcttcctcgagaaagggcttatatgaagagatgaaatttattgttatacttctcaattgtgaaccagaaaacttgggcttaattcccagctctgctacttacttgcttgaacagttatttgagctctgtatctctctttctgtatctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcaaaatatacttattaattgcacattatttaaattatcttatattcatatttattttctttgatattaccaagaaaggagaaatttgtcattcttgttctatgaagaactgactcacatgtgacttaattgttgaagtcaactgtgcatttctattagtctcctaattacctaatatttcccataaatgtcatatttttgcagatgttcacatgtatcttcctacgaagttatttcaggcttcccggccttcattcaacttacttgattcacctcatccccgacaggagaaccaggtaaatttgtgcaggaggtatttctattagctttttgaaaaactgccatctttatgggaaataataggactagtcattatggttcttgttactaactagtggtacgcaaaatgctattctggtgaagatacatgttcttttcagttcacttttacattgggcaagtttgtctggtcagactttgggaaaactagattgctgtattatacatctggaaggtttcattacttttgctttgcctttcattagtatttaaagaattccttggaaaaggtttagaggtgaaaatatgactcattctaggacattatttaagttgagcacttgtgaacttaatttcttgtcatcatttctcaaactaaaggttccctctgttcgtgtagaaatacatcttcctagagaccagtctggggaggtggactttaaagcactggttttacagttgaaggagacctcaagcttacaggaacaagctgatatcctctatatgctgtatactatgaagtaagtggtggatattatcaatctagtttaatgttcataatcagaggaattatagcataataaatagagcacagcttttggagtttcgctgatctggaattgaatatagtttaacaacctatccatcatgtgacttcaaaccctcagttgtcctcatttatagaatttggattatatatacctcatagagttattgtaaagattaagatataatatccatgaagtctctaatacaatgcctggcacatggtgggtgatcaataactgataaatattactgtcattaggttatttttaagcctccattatttggtcaaatgtacagataagtttttaactcaagaaaagtaagaatatagaggtttataggagaaagaaactaacatttttgtttgctatgtgtcaggcatcctgctaggtactttgtattagtacaaactcaatatgtccaaattgaactcctctctcctaaaccccacaagcttacacaaaaataatctgttctccctccttttccatgttgtagtcaccatgaagaggcaggatggactttcttcccctaaatttggtttggatgttgagatagatggtgacatacacataccaagaaggtgtggaatatttattactcacataataaggctttctaggaagagcaaagaaggttcccagcttgctcccaaaaaggcttgagagcccagggaaaggagactaaattgggggttttataatcattacaggatgagcattctcactggcttctagttttctttttttgttgtgtccttgtttggttttggtatcagggtaatgctggcctcataaaatgagttcggaagaactctccccttttccttttttttttttattttttttattttttggaatagtttgaaaagaattagtattagttctctaaatatttggtacaattcagcagtgaaaccatctggtcctgggcttccctttgatgggagactttttattactgattcaatctcctttgttattgatctattcagattttctgtttcttcatacttcaatcttggtagattgtatgtgttcacaaatttatccgtttcttctagggtttcctacttgttggcatataattgttcataacagtttctaacaattcttttaatttctgtggtatcagttatatctcatcttctttttttgattttgaagtgaggtctcgctctgttgcccaggctggagtgcagtggcatcatcatggctcactgcagccttcactgcccagtctcaagtgatcctcccacctcagcctcctgagtagctggtaccacaggtgcgtgccaccatgtccggctaaatgtttttttaattatttatagaaatgaggtcttactatgttacccaggctatatatctccttttcatctctcattttatttatttgggtattctttctttttttctttgtctagccaaatctttgttgatttttgtttatcttttcaaaaaaaccaacttctcattttgttaatcatttgtattgcttttttagtctctgttttatttatttccactctgatgtttattgtttcttccttttactaattttgggtttagtttgttcttgtttttctagttactttaggtgtaacattatgttgtttattttagacctttatactttttgatatatgcattcattgctataaacatctctcttagaatagcattttctgtatcccatatcttttggtatgttgcatttccttttcatttgccaaaagaaatttttgtaatttccttcttaatttgttcagtgaccccttggttgtttaggagcatgtttaatttccttgtatttgtaaagtttctgtggtttctcctgttattgatttctagttttatatcattgtgatcagaaaagatacttgatatgattttgatcttcttcaattcattaatacttgtttgtagcctagtatataatctaccctgcagaatgttccatgtaaagttgagaataatgtgtattctgtagcttttggatggaatgttctgtaaatatcaattaggtccatttggtctagtgtgcagtttaaatccaatgtttgtttgttgattttctgtctatgtgatctgtccattactgaaaatgggctgttgaaggcccgtactattattgtattgtagtctatctcttcctttaggtatgttaatatttgctttatatacttaggtgctccaatgttgggtgcatatacatttacaatagttgaatcctcttgcttaactgatcccccttatcattatatggtgaccttctatatcactttttagtgttttacttaaagtctatttttttaagacagtcttgctctgtcagccaggctggagtgtagtgccatgaacatggctcactgtagtctcaaactcctgggctcaagtgaccctccaacttcagtttcctgagtagctgggaccacaggtgcatgccaccatggccagctgatttttaatttttttttgcagagctggggtctggccatgttgcccaggctggtctcaaactattgggctcaagccatccttctgcctcagcctcccagagtgctgggagttccaggtgtgagccacagcacctggccctgaaagtctgttttatccaagtagagttacgtctgttgtcttttgctttccatttgcatggaatatcttttttccatccgctcacttttagtccatgtatgtcctcacaggtggagtgaatctcttttaagcagcatatagttggctcttggctttttttattcattaagctactctgctttttaatgggataatttaatcaactcacattaaaggtaattattggtaggtaagggcttactactgccatttaattaattgttttccagttgttttgtagaatcaatccttccttccttccttccttccttccttccttccttccttccccccctccttctttccttccttccttccttcccccctccttctttccttccttccttccttttttatttctctcttactatctgtctttatggctaagtgattttccttcataatatgttttgattttttgctttttatttttagcatatctattatatgtttttgcattgtggttaccatgaggcttacaaaaaatcttaacaatttaactatgattacagtaaaagagaagaaaaatctctttaactcaacctcccaacattttgagtttttgatgtcacaatttaaaatttttatattgcatatcccctaacaaattattgtagttactatttttaatggttttgtcttttaaccttcatactaaagatgtaagtaatttacacaccatcgttagattaatagagtattcatatgactgtgtactcagtgacatatatcttcagatgttttcatattattcattaatgtctttttctttcatcttgaagaactccctttagcatttcttgtaaaacaggtctgatggttatatatttcctcagcttttgtttgtctggaaaagtctatgtcttcttcatttctgaagtattcttggctggcagttttttcccttcagcacgttgaatacctcatctcactatctcctggcctataagggttctgctgagaagtctgccgttaggcttattaagattcccttatatgttatttgcttcttttttctcactgctttcagaattctctctttgtctttgatctttgacatttttattataataggttgtgacatagtcttatttggagtagaatttattttcaaatatatatcttcctattgaacatgtctaaagtcaaattcactgtctttactacaaacctactgctgttgtctttcctgactctattctgggtatcatcattccttcaagtaacccagacttgaaattgtgtcattgtcttcaattcctccccatcccctgcctctcgctacagcatcaacactaccacagggaatcattggccaaatctaaatcctctatgatttgactttcaacttttatttaccattgctcttcccttacaatgtgaatgctgtcaccaaaacagtctatttatcatacccaaagcacagcctctacatgcctaccttcataccttgattcttattttttcttctgcctagaatattctcctttaccacactccatttctacttcttgcatttctctctgtcaaggcctaggtcatctgtcacccacatgaaacttcctccaatctgtaatagtaaaaataatcttccactgattctgagatctcatagcacttttttcatatctttaaaatttgacagtgtcagacttggagaaaagttgtgaggatagtacaataaaaattctggatagccctccttcagatccatcagatgtttccactgagcttttaatctctctctctctctctttcacgttgatgtcatcatctatactcaatcacacacgcatattatttttttctgaaccatttgagagtaagtggcagacacgatccccatctaaccctaaataattcagtgtttatttctgaaaaattatgaactctcctacataagcacagtataattgccaaagtcaaggaattgtttaacattaaaccaatactattaactatctacagatactattaagatttgtcatatagcccaatagtgtctttatagaaaagaacatctaaaatcatgaattttattgagttctcaggtgtcttgagtctccatttatctggaacagttcctgagtcttcatttttcatgttgttaacatttgtgaggaatacaaaccagttattttgcagaatatccctcaatttcagtttatgtgttgttttgtcatgattaaattcagattatacattactaaggtaatgccaagttcttttccatgtgtcatatcatagtgttgattagtcccattgctgatactgtaaactttgatcgcttggttggatcatttggttaaggtagattcttccatgtacctacactgtaaagttattatgtcatcttttgtaattaaaaaagtatcctgtagagatgtactttgagactacgtaaatatacggttactcttcaaacttttgctcactgatatttttcatccattaatgactcttcctatagcacattttatttcatgttttttaatttaatatattgaatagatatattcctatggttcaaaaatttttaagtacaaaagaatatacagtgagagggtaaaatgtctttctcccatctctgttcccccagataccctgttccccttctcatgggcagtcagtgttgtgtgtgtgtgtgtgtgtgtgtgtgtgtgtatcctcccatggacatttatggatatgtaggtaaacacagacatatatggggataattttacccctatttatccaaaaggtagcatagtatacacacagctctaccttgctttctttcactaaaactatatatcttgatgataactacatatatattccaattatctattgcttcataacaaatcactctgaaactcagtagcttaaaataacaaaaatttaaaaatttttaaattatctttcacagttctgggacttgcctgtgttcagccaggcagttctcacctgaggtctctcatttagttttggtcaacaatttctggggctggaatcttcacaatgcttgcccactcatatgtctaggggttgatactggctgttggctagaacctcagctgaggttacctacagctggtacacccacagatgacctcctcatgtgtctctccacatcttcacagcatgatgactaggttctactagtaagtgtcccagctgggagctctattactttgtatagcctagcctcagaaattaggtaagtcacttttgccttaatcacaagcatgcctgggttcaagggaagggaacacagaactcatctcttcatgggaggagtgcgagagtcacattgtaagaagagtaggttggataggaaattgttgcagctattgttgaaaatatattaccacaatctagatctacttcatattttctgaataattgtgtcattccattatttgaatatatcataatttacttagccagcctcttattgatgaacatttgaattgttgccagaattcacaatcacaaaaatgctatggcaagtaccctcatagcatacagcatttcacgtgtgtgaaatttatcatgcaagtaaaccagaactcgaattgatagatcaaaaaataggtattttttaactgtacaattaaatggctttgaatgtattcacattgttgtgcattcttcaccactactcattttagaacatttgcattaccccaaaaagaagccccacttcctttatccatcaacccccaatccctccattcccccagccctaggcagccactaatctacattctgtctgtatagatttgtttgcttgggacattttatataaattgagtcttgcaatatgtggtcctttatgacaggcttctttcatttaacatgatattttcaagattcatccgtgttgtaacatgtatcagtacttcattcttttattgccagatattatatcctgtataaatataacacatcttatttatccattcatcagatgatggacatttgggttctttctactttttggctattatgaataatgctggtataaacattcatgtacaagttaatgtggacatatgtttttatttctattgactgtataactagtagtggaaatgctggattatatggtaattctgcatttaaccatgttaggaattgccaggctgtttttaaatattttcaatactgatatatatttccaaatagctctccaaaggaattgtccaatttttattccgatcagcagcatattgatggtgcctgttttctcaaagcctcaccaaaatagtgttatcaactttagggacttttgacaatctgataggttaaaaatgttatcttggtatagtgctaagttaaagtttttctaggagtgaggttgagcaccttttcctatctttaaaagccatctatttgttttgccagcagtatttgttttgccagcagtatttgttttgccagattttcttttgtttttaattttttaaatctacatgttggagttctttatatataagggaaattatcctatgaattgcaaacattttttcctagttggtaatttgtcatatgactttccttacagtgatttttgaaataattcatttgttaaatctttgtctttaatttcaactatattgaagcccatgaatagggtaaaagaatgcattttgtcaaaagcacagctaaaactaagacttattcttgtgtaggtactggctttcagagctgactgttaatcatagttttataaggattcttagtaaattacattgatttcctagtgagagagacctatcaaaaacaggcatgttcattataacactgaaagaaaagatgattgccagaagctttacttaaaactgatgtagtcctgtcgttaaaattctagaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggtactataaattcttgaatttataccaaatctaaataagcgtgctttttaaaaattggtttctataattgttttttaaaacaaccatagcctctaaccatttgagatgtcttttccacataaaatttgatattcagttcttttagtttgtgaatgacaagtaagaattgtagatttataaaatgttataaaccataacatctttataatgatattaagaattctatatcttaagaatgaatttacactaggttcctacctcctagaaagggaaacatccatacaccattagtgggaatggaacttagtatagctacttatgtaaaacactatggaggttcatcaaaaaactaaaagtagaactaccatgggatccagcagtccaactgctgggtatatatcaaaaagaaaggaaatcagtatatgggagagatatctacaactcccatgtttattgtagcactattcccaatagcaaaggtatggaataaacctaaatgtccatcagaagatgagcagataaagaaaatgtggtatatatacacaattggatattattctgcatcaaaaatagtaaaaccctgtcatttacagtaacatgaatggaactggagggcactatgttaggtgaaataacccaggcacagaaagacaaataccacatgttctcactcatatgtgcgagcttaaaaagttgatctcatagaggtagagagtagaatgatggatactagaagctgggaagggtagtcgggagtgggggatagagaaagtttagttaatgggcatgaaaatacaactagattgaaggaataagatctagtatttggtgtcacaatagggtgactatagtttacaataatttgttgtaaatctcaaagtaactagaagagcagatttggaatcttgccaacacaaagaaatgataaatattgaggtgatggatgtctcaattacccaggtttgatcattacatgttgtatgcttgtatgaaaatatcacatgtactccataaatatgtataactcttatttatccataaaaattgaaaacttaaaaatttaaacaaattttttaaaaagaaagaaaaaaaccccataaaccaaccaaacaaaaaagttcctactttctaggagatagatgaaaagacctcattgtttcttcctagaaatccttcttttctgatcttcatggtattttctgaggaagagagttcagtgtgtcattatgttaaagaggagcaaaggtttttcagctgaaaagagaaatgtttgtggaaacctgaggtgttacagaaacgataatattatgctatctcttgttaggcctgcacagaccttctctcccaccagaaacatttgacagtaggacttcctccagaacctcgagaaaagactatctctgcgtgagtatggctgggtttggtcaggcttctctgagaaggagtggtgtggacttagaattcccttgccctaatctgtcagtggatgataatgtcctacatatgttcacctctatcagagacacctagtggaagaatgttggtaatggtagggcaagagtaaatgaaggagaaaactcacagagtagtactcaaactctttttacttgttggattttccatacctgccattcaaaaaacaaaacaaacagggtaccctgaattagcaaccacaaaatgtcagccatactctggaaagagcaagtgaaagaaagtggctagagcacagggctgaccatgaaactccatgctgctcatggggaataaaggggatggaggtcatagtcaaagaggaaaaatggttacttacagagcaatgtgaggtagcacccctccaggaaccctgtaatcagagtgccactgtctgaggtctgccacagcctccaattggaaacagtaccctaagataggcttggcctggagggagatgtaagtcaagtgatggggctgggatggaaaattcagtctttatacatgagtcttccttttgccattggccatgccagtaaaattcatctgcagtaaatgtgtttaatttcatatcacaccagtgccaaaatttaaatcttgcaaacagtctgtatctccaagaaatatttttagagagattctaacttcattcataaatgatctgaagaatctgtttttctactaggagtaatttttaaaaagggtattcccccctgcttgccagttctacttctgtagccaatgtagttaaaaaaaaacttttgtcaatatttctccctcattttttcctggttaaactctatccagagcatgttttttgtttacaaaattttttttactacattggctacagaagggatacttttgctgatgtctgcatactccttccttcctggtttatgtccatgatttctgttacccttgagttccagttcaagctcccatatgaaggcttagagaaacaaaagttccagcaagcttcaccaccgcgggcttaaagtgctctgggtactaaatagactcaaaaagcagtctaggccacaaggactgcaattcctgggcaaatccttgtgctatgctggactcgaagccaatggacttggggtgcatgcggcctagtgagacatcagctagagtgggcaaaggagtgcttgtgccacccctcttccaactccagatagtgcaactctgggagagaatccttccttccactgaggagaggagaggaaatagtaaagaggactttatcttgcaagttggataccagctcagccacagtaggatagggcaccaggcagaggcatcagactcccattccagtccgtagctcctggatgacattttgacacataccttgcaccagaagggaacctgctactttgaagagaagtacccagttttggcaggatttatcacgtgctgactaaacagcccttgggacctgaacaatcagcacagtgaccagacattctggttccaagtgtgaccaaacacatgcccagccgtggtgggtatagggagagactccttctgcttaagaaaaggagagggaagagtaaaggggactttttcttgcagcttaggtaccaggttggccacagtggggtagagcaccaagcaggtttttgaggtcccggattacaggcctggcatttggcctaggaactgctaacaaatgtacagtgcagtggtggttcaagaagttttgcaaaggagatgagagccttgaagatgaggagcatagtggcctgctattgaaagttgacaacgaccaattgagagcagttgttgaagctgatcctcttaaaactgcatgagaaattgccgaagaactcagcatcgaccattctacagtcagtcattcagcatttaaagcaaattggaaaggtgcaatgggagaaaatatttaccaactacctatctgataagggattaataaccagaatgtataaggagctcaaacaattctatagggaaaaaaatctaatagtctgttttaaaaatgggcaaatggtctgaatagacatttctcaaaagaagacatacaaatggcaaacaggcatatgaaaaggtgctcaacatcattgatcatcagagaaatgcaaatcaaaactacagtgaagtatcatctcaccccagttaaaatggcttttatccaaaagacaggcaataacaaatgctggcaaggatgtggagaaaagggaaccctcatatattgttggtaggaatgtaattagtacaactactatgaagaacaatttggaggttcctgaaaaaagctaaaaatagagctgccatatgatccagcaatcccactgctaggtatatacccaaagaaaggaaatcggtatattgatgagatatctgcactcctgtgtttatttcatcagtattcacaataaccaagatttggaagcaacctaagtgtccatcagtagatgaatagatcaagaaaatatggtacatatacacaagggagtactattcagacacaaaaaaaatgagatcctgtcatttgtaacaacatggatggaactggaggtcattatgttaagtgaaataagtcagacacagaaagacaaagttcacatgttctcactgatttgtgggaactaaaaatcaaaacaattgaactcatggagatagaaagtagaatgatggttaccaaaagactgggaagggtagcagggtttatgggcgttgggggtggagatggttaatgggtacaaaaagtagttggagagaatgaataagatcttgtatttgatagcacaatagggagactatggtcaaaataatttaattgtgcgttttaaaataactgaaagggtgtaattggattgtttgtaacacaaaagataaatgcttgatgagatggataccccatttaccctgatttgattattatatgttgaatgcctgtatcaaaaatctcatgtaccccagaaatatatacaccactatagacccacaaaaattaaaaattaaaaaaaaatttaaagaaaagaatttgaggagaggacataattcaatccataaaatcttgcttctggaaaaacaatcttttttgtatcagttttgtgacactgtaggtaatccaaagaagatggcatggttcatgccccagagtgctttgtgtcagcaggagaatcagaagtgtgtgaggatgtgtgtatacgtgtgtgtgtgtgtgtgtgtgtgtgcatgtgtgtgaattgaaactatagaaaatcaaacaactctgtcaactgtgattgtaaagtaataaaatggcttcaaaaaggcacagctagtattccattgtaggggtgggatgctgaagagatgttggttaaagaaggaatacattctaatgttcagtagcagagtagggtgactattgttaacaacaatgtattgtatatttcaaaataactagaagagaggacttgaaatgttcccagccaaaagaaatagtaaatgctcaaggtgatggataccgtaaataccctgacttgatcattacacatcctatgtatgtaacaaaacatcacatgtaccctgtaaatatgtagaaacattgtgtattacaaaaaaagcacagcttaaaattaatttagtactttgtagccataatagttacttgtcaaatgttcaaagctaactatgaaagactagtctagaagaacatcatggtgtgagttttaaataaattttgaaggaggaagagaatccagatttagagagaagagagcagagctcctctaagttgatatgggccagagtggtttcaggaggcaatgaatgagctttgaagtttgaaagaatcagaatgctattggtaatgatgaaatgttgaggcagtgacttggacttggataaagcttcttcattttttcaacatatttaagattaagtggttgtagaatattgtctttctttgctgtctttttccttagacctctgccctatgaggcgctcactcagctgatagatgaagccagtgaaggggatatgagcatttcaatccttacacaggtgagaagaattgtaaaggctaatctggtgactgatattttaaagtttgttttcaattgatctagcaatttccaaagacaacaaaataggcattgtgagacctaggccattatttttgtctatatctactctgtgtgcaggaaataatggtatatctagccatgtatatgcgaacccagcctggcctctttgctgaaatgtttcgacttcgaattggtctgatcatacaagttatggcaacagaactggcccactcccttcgatgctcaggtacttaattcagtaactattttaggtggaattcacttttgatgtaagtttatagagtttggaataaggaaagaaagaaagctaaaacatttttatccatagctcagaagctggatatggcaaccttgttcccctgttggtcactatttatgcaagtcaaggagctgatatgatgacacatttgtgtatcagttcgcagcttcagaatgccatctcctgtgggctcttcactccaaatccctcttgacttatcactcgttgctaacttcatttctctaactctggagagtatttgagtgtgacagacagagttgggttaagatttaggcagtggagcgtctgtacaccaagaatgagtcactacatcagtggatcatggtgtcagtattctgtctagtcaccatcatgactgaataaaggaagatgacattttcattaacatctatctgacaagactctctttgaaattaactataggtgtatttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaattgttttatacctaccatatgccagatactgtgctttttgctttaagtttacatatattgtgtcatttaatcctttcaagaatcctctggagaagaaggtattattgtgtcacttttaccaataaagaaactgaaactcaagaaggttaactaacttccccgaagcaacatagctagtaaatagtggaatttgagtctgagtccacctgattgcaaatgatttctagttcagtacattgttatagataaacattatatagtataatgttgtttttttttttgcgagagagtgtgattgctcaataataaacctcaataagggataagcccctgaatattcacttttccttaatttagcctgttatatttcttgttttcctgtggattcatgaaaaccatggctctttattccttataggataaagtcaagatccctgggtctgatgtttaataccctcaacagtctggcctttatcttctactcccacagtacttcccactaattttgtcagttccagtccttggagattgatgtctccattgatttcaaaggcaattattgtctatacctctcatttggcacatagaatatgcaatgttttattgtttatcttgttttcatgttccatcactcccaaagagatagtcagactcaagattaggtatcatgtcgtcatacctgcttgcacaaatgttacttaaaatgatgacctgcatgtagtctacttttaataaatgtgtgatgctgattaacatgttcaagttatcctcatatattcataatttcatggattcaaatctatctcttttaagtctctattatttccaggctgagaagttttaattattttagtttatctgcatatatacattcattgtctttctctgaatggcctccagttccattgttcttctttcattcttcccaccttcaaataaagattttactaagtaccctaatggtctggaagcagggtgaagaagaaatcaattacctcgctaatccacaaactggatagtcagtccttaaataattaagaatctatggaagtaagaatacctaagcagtagggtgctatcaatttattttgtaattctgttcttccaatcaagtgactcagaaattctaagcaagaaaagaaatagagaaaatatagagagggcatggcaggcaaattagaagtccttctgttctaacatttctgctgactagctgaggaagccacagagggcctgatgaatctcagtccttcggccatgaagaatctcctgcatcacattctcagcggcaaggagtttggagtggaacgaagcggtgagattgaataactgcattttcatttcatactgtttggtttaagtgtctcattggttttaaaatgtttttccttcatcacagaaacctttttccccaaataaataaactccaatatataaaacagaaaccaagctgtcttctggaacaagatttggaaaccactatatttttccttaaatggtatatcaactaagtggattgattactatcatgtttcatttttaactgtttaatgcattccctcacattatcttaagcctccactttaggacaactagcaacccatatcatctgaaactttcttgtattctaattggcaataattcagtagctcttacagtattgtattatgtgtatagctgcttacagtacttctaatgtaacccttcaactttaaactcacaaattaatagtccacctacatttgtggttttggttggatttggcattgcgtacctaaagcagcagagcaaatgaaaagtggtcatctctcatgctcaactttcaaggttagggtaagtagatatatatggtcagatggatggatgtcagaccttagagtggtaaaagaaagttgaaaagcagtgcgtttcaagaagggtatcttgctaaaatgcacattttgattcagtagatctggggtgggacctgagattctactaacaaacttgtaggtggtactgatgctgttggtccatggaccacatttcaaatagcaaggttatagtttttaaattaagttaaaaataaggatatatatgaaagttttttttaaatgtgatggggaagaaattgaaccttattatcctctctctttctctgtaatctctcatactacatagttcgtcccactgattcaaatgtcagtcctgctatttctatccacgagattggtgctgttggagcaaccaaaacagaacgaactgggatcatgcagttaaaaagtgagataaagcaggtaagatactacctgggagattagctgggatattgccatgtttcagaacattcttttggaatcagactttgttgggtcatttattttgtttcacattctgagtttaatttgagccatttatgtttcaggtggaatttcgtagactgtcaatctcagctgagagtcaggtgaaacaactagggatcatttaacatggtttaacttacctttagttctgtataacatgcatgagctcatggcctttttacaaataagataacaagtcatggagtagattgtttgaatcgcctttataacagtcattttgcagatagctttcctttttctggaccaaagtactttgttaattttagaaggaaagtaacttgcatctgataataagaaattgaagtttctcttattaggactgatgtaattttggaattaattttctttataaaacaagacttagacttcaagcaaagagtctttgcttggccagagtttaggtgggcttctcaaccttttcctaggcccatttgtgcacttccttgtaaaatccagctttagcaagagaaccctgctaagtcagtttagccagaaactcctatcctcgatatcttatcatccttgacatctgatcaggctcctcatcttctaccacccccaggtgatgtccaatcaccctggcctgtcttcagcaaaaatcctgttaagatggtttagccagaatcctccctacctctgatgtttccctcttagtaattttccaccacttggctataaattcccacttgattatgttgtattcagaggggagcccaatctctctcccttactgcaagacctcattgcaatggttctgtacctattaacaatggtcctgaataaagtcttccttaccgtgctttaacaagtatcattgaataattttttctttaacaagatgtagaaaaggtgctgtggacacagagggagaaacatctaaatcagtctgggagatagtgggagtcactaaataccatgttgtagcctcttaatttttcctgcaggtgagaatagagagcggttgctttatacaaggaaatagttaacaaaagcttccatagcttctttttaaaactctaggaagtcatgtggtttcaagatctccaagttgagaaattactgatttggcctctcctagaagcacattttatgaaaagcttaaaactactcctgttttcagaatagaattatgatagcttgcagtattgaaacccccagaagaggagtggtgaaatggaaatttggagttttgtttttagttttcgtttcttttttttagctttttagcactggggtctcactatgttgtccaggctggagtgcagtggctattaacaggcacaaaatcctggattcacgcaatcctcctacctcagtcaccagagtggctgggactaaggcatgccaccaccttgctatttggtttttttaaaaggaattagaaaccatttaggaagacaatgagccagtgcttgaagcttaatttgaggtaacttgagtacactcatcaaataccctatggcatttatatttatgcaagaataagtatgaaaatggagtaagaaagggccttgtattcactttacagttttctcgaataatttgaataatctgaatattttcctatttgaaacgtgaaagaactacattcagtactgaatagttagttacattggcattatctgtaaataatctttgatttggttgagagttattggataaacattttataattgttgatagtcactcagtattacttataagttcattatatatttacaacttgaagtacatgttcccagctacattaatatgatgttgagacttgatctacccagctacatcatttaagttttttctaaacattcactacctataggttttcaagggagccaaaatcactaggactataatttagaggattgagagtcctaaatttgcattactttcttatttctaaatattaacttccatcctcacctgcctgtctggtattttgtattgttctaagccattttttccctatcactcaagaatgccctcttttctgattatgaaaaaaaaaattataagggtatttttatttcttttcccttcaccatggcttctagggtaaagctatttcatcagctttttaatgattatgtgctgactacatactgaaatagtctgtatttttactccactagtgacttaaaagtacaaataattgtttcctggcctcatatcttttaaaattttattttctcaatttgttctcatagtccaatggtggtcatcccctgggtatagatttgatgtcaccgtcttttatggtaactgctgtgatcttctcgtatatgccattcacatgtgctttgaatatgctcttatataaatcatgacatatactggttgattaaaaaaaaaattaatcaagaattaaaataagtataaagcaatttcatatatgggggtgaatcttttcatttattttccaataacatagggaagggagttcaactccaacctctttgcgatttcagaaaacaaaattcaatttgctaagtattggttaagtataaattcttggtcccaccctaagtacacagagtcagaaagactgcggatgaggcccagtaatctgttttatttagatgattctgatgcatttttaagtttgaaagccactgggttagcttttcttctgattatgaattcatttagtaaatattaattgagtgccagttttgtgccaggcactgtgaacaaaatggatgtggtctttgccctcgtgaagcttacaatttaggaggactgacctctaattaaatttatttggtttaaatcaaagactcataatggcctatgatttcagatttctcaagctgaagagatttaggctagacaattaccaaacaaaaaatggaaaattattcgaaacaatattagtatttaggttaacctaaatcaaataccctgtaatgaactaataagacttggccaactctatcatatccacactaacataggacaggggtatagaagaaaatttaaaaactcaaaatgattgatatttggctttggaaaacagtctgaattgtactttatcagatctataccctttctggtttgacctcacaatcaacagcctaggatcttggtggtataaacaagacaatgaagataattaaatggcagttcatctactcaatagatcagtgcgatagtcacttgccagtagaaatgtttgggggctcttttcttttttacattgcattggttggtgatttaggcatttggcccaaattaaaacgtgagaagttattttctcagaaaatatttctattatcttctatcttatatttatttctgaatttaaactgttaaccactttgcccaatgtattttatcctttacttagtataagtttttcaaagttcattatgttttagcatgtatcaaaagtttatttttttcattgctgaataatatcctactaaattaatgtaccacattttatttatccattcatcagttgatggacacctggattgtttccactttttggctgctatgaataattctacaatgaaccttcatgcacaagtttttgtatggacatatgttttcacttctcttggatatatatctaggagtggaagtcctgggtcatatggtaactatgtgtcgcattctgaagaactgccagacatgtccaaaagggctgcaccattttacattcccaccagcagagtatgagagttccaatttctttacatcttcaccaacccttacaattgtcttttttattatagccatcctgatgggtgtgaactggtatctcgtagtggttttgatttgcattgccctaatagctaatgatactgagtgtcttttcatgtgcccaatggccatttgtttatcttctttagagaaatgtcaattcacatttgtacctattttaattttttttgtctttttattgttgagttgcaaggattctttatatattctggatacaagtcccttttaagatataaaatttgcaaatatttctcccatcctgtgggttgtcttttcactcaataccattaagtattcttcaaacaacaaaaatttttgatttccacaaagtccaatttgtctattttttcttttgttaatcatgatgtttttggtgtcatatctaagaaggctttgcctaacccaaggtcacaaagatttattcctatttgtgttctaagggttttatagagttagctgttttatttaggtctatgattatgtatggagggatccccaagatcaccctcagatttaatgattcactaggaagactcatagatctcagcatatagtcatactcactgctacggtttattacacctaaagggtacaagatgcattgggcacagtgtaactacagtcaacaataatttattgtacattttaaaataataaaaagtataattggattgtttgtaacacaaaggaaggataattgcttgagataatggataccccatttaccctgatgtggttattatgcattgtatgcctgtaacaaaatgtctcatatacctcataaatatataaacctactatgtacctacaaaagttaaaaaaaatttaaaagagtcattggtcaaagtctagggaaaacagacacaagcttccagagtactctgtcagtagagtcaccctgcaatgagttgtgacaagatgtcattgccaaccaaggaacctaataaagactcagcacccattgttcttgttgagggctggtcacgtaaacagcctctgtctggcgtgtatcaaaactctggactcccagaaagaaagcaaacgttcaacataaaccatagcgtttgtacagtttaggcatggtaagccactgttattagttctgggaatggtgagaactctcccagaatccaagtttctaagtttctaaatgccagccaagggccaaccttgtaagcaagcctttccaagaatagcagttctggcctactgtcttaactcttttctgcacaatgggcttaatttttgtgtgtggtataaggtagagttcaacttcattcttttgcatgtggatgtcactgttccagcaccatttgttgaaaaggctatttttccctcatttaattatcttggcgtccttgttgaaaattaattgaccaaaatataatggtttatttttgaactccctgttctattccatcgatctatatgtccatcctataccaatatgacacagttttgatagttttgtagttttgatagctttagagtaaattttgaaatcaggaagtgtgagctctccaacttcagtcttctttttaaatatgaatgttaggatcagcttgtcagtttctgcaaagatcccagctggtatgttgatagagattgtgttcagtctgtacatcagtttttgaaatattgccatcttaatgatgttaagtcttctgacccatgaatatggaactatatttcaatttatttaggtctttaatttttttcaacatgttttatagttttcagagtatttgttttggacttcttttgttaaatttattcctacatattttgttattcttaacgttattttttaatggaattgttttcttaattttattttaatattgttcattgctgctgtttacaaatacaactaatttttttattatagtaagacatttaacatgagatctatcctttaaaaaatttttaagtgtacaatatagtatcattaactataggcttgatgttgtacagtagatctctagaacgttttcatcttacataactgaaactttatacccattgaatagcaagttcccattttcccctctacccagcccctgacaactaccgttctactctctgcttctatgagtttggctgtttcagatacattacataactggaatcatacagaatttgttcttctgtgactggcttatttctcatagcatagtatcctgcaggttcatcgacactgtcatattttgcaaaatttccttcgtttttaaagtctgaataatattccattttatgtattaccagattttcttttgccattcagttgttaatatatatttaggttgttttcatatcttgactattgtgaataatgctgcatttgaacatgggcatgcaaatatctcttcaagattctgacttcaattcttttggataaatatccagaagtgggattgctgaatcatatggtagttctatttttaatttttgaggaacctccataatgtgttccatagcggctgcagcattttacattcccagcaacagtgtacaagggtcctaatgtcttcacattctcaccaatacctgttatctttgggtgtttttttaaccacggtcatcctaacaggtgtgaggtgatagctcattgtggtttgatccgcatttccatgatgattagtgatgttgagcatctttacatgtgtgtggtggctatttgtatatcatctttggtgaaatgtctactcaagtaaaatttaattgatttttgttattgatcttatatcatgaaacttcactgaactcatttattagttgtagttgcttgttagtgaattccttagaatttctatatacaagatcatgtcatctgcaaatagtttttacctcttcttttccaatctggatgccttttatttcttttcttacttaatctccctggttcaggccccccataaaatgttgaatacaagtgataagagtggacattcttgtcttgttctgatcttcggggggaagccttcagtcttcaaccactcattatgatgttagctgtgggttgttgtaggaaaaaaatctaaacttttattagattgaggaggttcccttctgttcctagtttgttgagtgtttttatcatgaaggtgtgtcgaattttgttatgtgtttttttctgtatctattaagatgatgcgttttttatcttttattctgttgatgtagtgtattacattaattgatgttcagatgttaaaacagccttgaatttctggaatcagtcccacttcatgttgtataatccttttagtatatcactgaatttggttttctagtatttcctggaggattttcgcatctatattcataaaggatattggactgtagttttctggtgacatctttgtctgattttggtatctgggtaatattggcctcatagaatgacttgggaagtgttcccttctcttttctggaagagattgtgaagagctagtaataattcctctttaaatgttttgtagaattaaccagttaatccatctgtgcatgggctttactactatgtgggaacgtttgtttatttgtttgtttgttcgtttgagacagagtctaacgatatcacccaaggtggtctcaaactccggggctcatgcaatccttccgcctcagcctcccgagtagctgggaatacaggcacaagccatatgcccatgcaccacgagccaagaacccatactttgaaggaagttttgtacttactaatttgatatatttgtttgtaatagttctattaagatgttatctttctttatgagttggtttgggtagtttgtgtctttctaggaatttgtctgtttcattgagattatgtaatttgtccgcatatggctgcggatggtatgcccttataatcctttttctttctgaaggtcagaattgaggtctttatttcccctttttttcttggtctttctatctaatgatttgtctattttgttgatattttcataggaaaaaattggggattcatatgctttccctattgtgtttctagtctctatttcatttctttccactctaatccttattatttccttccttctgcttgctttcaatttagcttgctcttctttctttattgtcttcaaatggaaagtttgtttattgatttgagacatttatcctttctttaatataggcatttataacataaattgttcgttaagtgctgttttagctgcatcccataagttttgctatgttgtgctttcgttttcattcatttcattattttctaattttgctagtgatttttttccttaatgcatttattatttagaagtgtgttaatttccacatttgtaaatttccttaatttatttcgattactgacttctgttgtggttagagaacatacttcgtatgatttcaattttaaatttattatggctcatcttatggcccatgagggcaacaaactaaaccatggacgagctagaagtttaacagagataatcaggtcaagagacagctaagaatgtcccaaatcatcagtatttttatgacttttctcatgtatcaccagattgctttcaaaaaggattgtaccagcgtacagcactgctagctacatataagtctactagcttcactataacctctttgtcttggctgcttcacttaatatttggtttataattctgcagagtaggtttattgttcactataaagttcaaagacttgggccgggtgtggtggctcacgcctgtaatcccagcactttgggaggcccaggcgggtggatcatgaggtcaggagatcaagaccatcctggctaacatggtgaaaccccgtctctactaaaaatacaaaaagttagccgagcatggtggcaggcgcctgtagtcctagctactcgggaggctgaggcaggagaatggcatgaacccgggaggcagagcttgcagtgagccgagattgcgccacgccactgcactccagcctgggcgacagagcgagactccatctcaaaaaaaaaaaaagttcaaagacttcatcatagaaacagagataacttttgatttatgttctttcctctcctcttccaagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaaggtgagcataatacattgttgatgtctcatttttgccccttgaaattctcagtctccttggcagagatatgacatgactaatataatcactgcaattatgtaaaagtcataactcagatagacaaaaccaagaagaaaacataaaaatgaaacagttgatttgttattgtggcattattaataatttagtctctttctattattgttgccatagtcttgtttctaaattagacttttaaaatcatcacctctctgcttctggccatagttggacattgtgatacatttgctgctaatcaaacgaatttgttactaaagagctaactttctttgtagctgtggagggttgtaaatgttatttgtagcaacgtgctatcagtagagtaaaacaaatgtatcagtagagtaaaaccaagtatcagtagagtaaaacaaatgcagtacttggggagtttgtgttaggagttattacctatattttttcttggatgaaaactactaaataaatgcaaagtcataatgatggtaatagttcggagactctttgatgtgaccaatatttatttttcttttgaaggcctatttggccaaagaaatttaagggcatgccacactattatggtggtgacagttttagagggccaagaacactattatgctcagcataggtctcattcatagtctcttaggtgccactttctgcatcactggctttaataaggacctgaagatcacttcatccaggacttaaaacccttcagttatgttttttcccctttgggcatggatattcttccaaggacagaatcaggtgatcttttggaaaggtaaaagttggttcctcagactatgggctctggcaatcttcctttaaagagtactgataacttgctttttttgcagctaacttctatagcacaatggtgacaaatattattttatctcttcagttatgcatggattatggcaatgttctatgtgctcatacagcaaagaacaaaacagataataatcttcattctccttgaacttatattctactagggaggaacaaattataaataataaacagtaaataagcaaagtatctagaatgttaaaagatgataagtactgtgtaaaaacaagaacagggtatgagtatttatgaagggatgggatgcttagctagcaaatgtagtaacagtacatgtccgataaatgcatgtcttgatttcattttcaaattaagactttatgttcaaagaaaagcacttaaaatttaaatgaaaatatattgttttaaatcattcataaaccaatatctctcatatacaacatgcagtgtacagtaattaaaattggcatttctgaaagctttgttataaagatatttagagttatacccagtaacagatagctttgttgaatactgtaatatggaacaatagccagttctataaatgactttaaaattctaaaactattggtgtgctaggaatgacaaatttgatttgtgtgaatactctttaaattctgtaaaggtttttttttctttttttttaattatactttaagttctagggtacatgagcacaatgtgcaagctcgttacataggtatacatgtgccatgctggcccactgcacccatcaacccgtcatttacattaggtatttctcccaatgctatccctcccctcgccccccaccccatgacagacctggtgtgtgatgttccccaccctgtgaccaagtgttctcattgttcagttcccacctatgactgagaacatgtggtgtttggttttctgtccttgtgatagtttgctcagaatgatggtctccagcttcgtctatgtccctgcaaaggacatgaactcatgcttttttatggctgcatagtattccatggtatatatgtgccacattttcttaatccagtctatcattgatgggcatttgcattggtcccaagtctttgctattgtgaatagtgccgcaataaacatacatgtgcatgtatctttatagtagcatgatttataatactttgggtatatacctagtaatgggattgctgggtcgaatggtatttctagttctagatccttgaggaatcaccacactgtcttccacaatggttgaactagtttacactcccaccaacagtgtaaaagcgttcctatttatccacatcctctccagcatttgttgtttcctgactttttaatgatcaccattctaactggtgtgagatggtatctcattgtggttttgatttgcatttctctgatgaccagttatgatgagcattttttcacatgtctgttgcctgcataaatgtcttcttttgagaagtgtctgttcatatcctttgcccactttttgatggggttgtttcattttttcttgtaaatttgtttaaattatttgtagattctggatattagccctttgtcagatgggtagattgcaaaaattttctcccattctgtaggttgcctgtgcactctgatggtagtttcctctgctatgcataagctctttagtttaattagatcccatttgtctatttaggcttttgttgcaattgcttttggtgttttagtgatgaagtccttgcacatgcctattgcctaggttttcttctagggcttttatggttttaggtctaacatttaagtctttaatccatcttgaattaatttttgtatgaggtgtaaagaagggatccagtttcagctttctacatatggctagccagttttcccagcaccatttattaaatagggaatcctttccccatttcttgtttttgtcaggtttgtcaaagatgagatggttgtaggtgtgtagtgttatttctgaggcctctcttctgtcccattggtctatatctctgttttggtaccagtaccatgctgttttggttactgtagccttgtagtatagtttgatgtcaggtagcgtgatgcctccagctttcttctttttcttaggattgacttggcaatgcgggctcttttttggttccatatgaactttaaagtagtttttttccaattctgtgaagaaagtcattggtagcttgatggggatggcattgaatctataaattatcttgagcagtatggccattttcatgatattggttcttcctatccatgagcatggaatgttcttccatttgtttgtgtcctctcttatttccttgagcagtggtttgtagttctccttgaagaggtccttcacatcccttgtacgttggattcttaggtattttattctctttgaagcaattgtgaatgggagttcactcatgatttggatctctgtttattattagtatataggaatgcttgtgaattttgcacattgattttgtatcctgagactttgctgaagttgcttattagcttaaggagattttgggctgagacgatggggttttctaaatatacaatcatgtcatgtgcaaacagggacaatttgacttcctcttttcctaattgaataccctttatttcttcctcttgtctgattgccctgtccagaacttccaacactatgttgaataggaatagtgagagagggcatccctgtcttgtgccagttttcaaaggcaatgcttccaatttttgcccattcagtatgatgttggctgtgggtttgtcttaaatagctcttattattttgagatatgttccatcaatacctaatttattgagagtttttagcatgaagggcttttgaattttgttgaaggccttttctgcatctattgagttaatcatgtggtttttgtcgatggttctgtttatgtgatggattacttttattgatttgcatatgttgaagcagccttgcatcccagggatgaagccgactcgatcatggttgataagctttttgatgtgctactggattcggtttgccagtattttactgaggattttcccattgatgttcatcagggatattggtctaacattctctttttttgttgtgtctctgccaggctttggtatcaggctgatgctggcctcataaactgaattagagaggattccgtctttctattgattggaatagtttcagaaggaatggtaccagctcctctctgtacctctggtagaattcggctgtgaatccctctggtcctggacttttttttggttggtaggctattaattattgcctcaatttcagaacctgttattggtctattcagagattcagtttcttcctggtttagtcttgagagggtgtgtgtgtccaggaatttatccatttcttctagattttctagtttatttgcatagaggtgtttatagtattctctgatggtattttgtatttctgtgggattggtggtgatatcccctttatcattttttattgtgtctatttgattcttctctcttttcttctttgttagtgtagctagcagtctatcaatttttttgatcttttcaaaaaaccagctcctggattcattgatcttttgaagggttttttgtgtctctgtctccttcaattctgctctgatcttagttatttcttaccttctgctagcttttgcatttgtttgctcttgtttctctagttcttttaattgtgatattagggtgtcaattttagatctttcctgctttctcttgtgggcatttagtgctataaatttccctctacacactgctttcaatgtccgagagattctggtatgttgtgtctttgttctcattggtttcaaagaacaccttcatttctgccgtcatttcgttatgtacccagtattcattcaggagcaggttgttcagtttccatgtagttgtgcagtattgagttagtttattaatcctgagttctaatttgattgcactgtggtctgagagacagtttgttgtgatttctgttttacatttgctgagaagtgctttacttccaactatatggtcaattttagaataagtgccatgtggtgctgacaagaatgtatattccgttggtttggggtggagagttctgtagatgtctattaggtgtgcttggtgcagagctgagttcaagtcctggatatccttgttaaccttctgtctcattgatctgtctaatattgacatggggtgttaaagtctgccattattattgtgtgggagtctgagtctctttctaggtctctaaggacttgctttatgaatctgagtgctcctgtattgggtgcatatatattaggatagttagctcttcttgttgaattgatccctttaccattatggaatggccttctttgtcttttttgatctttgttgctttaaagtctgttttatcagagactaggattgcaaaaccctgcttttttttgctttccatttgcttgggagatcttcttctatccctttattttgagcctatgtgtgtctctgcacaagagatgggtctcctgaatacagcacactgatgggtcttgactctttatccattttgccagtctgtgtcttttaattgcagcatttagcccattcacattaaggttaatattgttatgtgtaaatttgatcctgtcattacgatgttagctagtgattttgctcgttagttgatgcagtttcttcttagcattgatagtctttacaatttggcatgtttttgcagtggctggtaccggttgttcctttccatgtttattgcttccttcaggagctcttgtaaggcaggcctggtggtgacagaatctctcagcatttgcttgtctctaaaggattttatttctccttcacttatgaagcttagtttggctggatatgaaattctgcgttgaaatttcttttctttaagaatgttgaatatcggcccccactctcttctggcttgtagagtttctgccgagagatcagctcttagtttgatgggcttccctttgtgggtaacccatcctttctctctggctgcccttaatatttttttccttcatttcaacctgggtgaatctgacaattatgtgtcttggtgttgctctttttgagaagtatctttgtgttgttctctttatttcctgaatttgaatgttggcctgccttgctagtttggggaagttctcctggatagtatcctgcagagtgttttccaccttggttccattctccccgtcactttcaggtacaccaatcagacgtacgtttggtcttttcacatagtcccatatttcttggaggctttgttcgtttctttttacccttttttgtctacacttctcttctcgctttatttcattaattcagtcttcagtcactgatatcctttcttccgcttgattgagttggttactgaagcttgtgcgtgcgtcacgtagttcttgtgccgtggtttgcagctccatcaggtcacttaaggtcttctctccactgtttattctagttagccattcatctaatcttttttcaaggtttttaccttccttgtgatgggttcaaacatcctcctttagctcagagaagtttgttgttaccaaccttctgaagcctacttctgtcagcttgtcaaagtcattctccatccagctttgttccgttgttggtgaggagctgtgatcctttggaggagaagaggcgctctgggttttagaattttcagcttttctgctctggtttctccccatctttatggttttatctacctttggtctttgatgttggtgacctacagatggggttttggtgtggatgtcctttctgttgatgttgatgctattcctttctgtttgttagttttccttcttgcagtcaggtctctcagctgcaggtctgttggagtttgctggaggtcccctccagaccctctttgcctggttatcaccagcagaggctgcagaacagcaaatacttctgcctgatccttcctctggaagcttcgtctcagggggcccctgcctgtatgtggtgtcattcagcccctagtaggaggtgtctcccagttaagctacacgagggtcagggacccactagaggaggcagtctgtcctttctcagagctcaaacactgtgctgggagaaccactgctctcttgagagctgtcagacagggacgttcaagtctgcataagtttctgctgccttttgttcagctatgccctcccgctagaggtggaatgtacagaggcaacaggccttgctgagctgaggtgggctctacccagttcaagcttcccaggcagctttgtttacctactcacgcctcagcaatggcggacacccctccaccagccaggctgctgccttgcagttcgatctcagactgctgtgctagcagtgggcaaggctctgtgggcatgggacctggtgagccaggcatgggatataatctcctggtgtgctatttgctaagaccactggaaaagtgcagtatttgggcgggagtgtctctattttccaagtacagtctgtcacggcttcccttggctaggaaagggaaatcccccaaccccttgcgcttcccgggtgaggtgatgccccaccctgttttggcttgccctccgtgggctgcacccactgtccaaccagtcctaatgagatgaaccaggtacctcagttggaaatgcaaaaatcacctgtcttctgcattgatcacactgggagctgcagactggagctgttcctatttggccatcttgaaatggagacccaaggttttttataaacatcttttttattaatcaatcataacatggcaaaattgcacacttgccatttctgaaaagtgatccaaactctacatccacagatgaaaaattcttatagaattttgtgaaaagcatacattttgagttaaaaaaattttatagctgttggagtgccatgaaattaatacttgcattttggactgctgtagtttatactttttatatgtttcaaatcaggtgtgcaccatttgtacttagaacaccacaaaatgaagtatctaaaatcccttgattttaatatgtgttttggtttattaacaaatgatagtaatttcttacacatttttggaaattacttgtataagaatatatgcatctgcttatggatacagtgtgtaaataaaacttgtgctcaccaaactatcgcaaggacagaaaaccaaacaccgcgtgttctcactcataggtgggaattgaacaatgggaacacttggacacaggatggggaacatcacacactggggcctgtcatggggtggggggaggggggagggagagcattaggagatatacctaatgtaaatgacgagttaacgggtacagcacacccacatggcacatgtatacatatgtaacaaacctgcacgttgtgcacatgtaccctagaacttaaagtataataataaaaaaaaaacaagtgttaaaaaaaaaaggaaaacttttgctcactaaaatataagtaaataaataaatgcatgtcttgagttttttcctatggcctaaaattttttctaaggcctgtttgtgatggccgtgcgacctagtatgatatctttccagatagtctctgaatatttgggactagtctatcccaaaagatagagctttcctactcattccatttccctaagtagaggatgaaccttaggtctcctatagtccaatcctgcatcttggcacttaggcatcacaactccatggcaagggcacttggactgcagagccccttgctagtctgtgattactcagcatataccacatgaggcacacttagaaatacagcgtctcctcatagcctccccgttgtttgtctatccttggtgatatggtttttggtgatatggttttttttctgttttgcagtgtcacggactttctgttgaagggtttgtccttccttcctctaccactagagaggtaagagtctctttcttgcacatttatgtgactgataactttgctggctaaagtatcccagtgatcacttacttttcaaagtgacagatccatgcttttataaatcaactgaacatgaaatgcatttgaagaaaagacaatttttttaatggaaagagaatattatagaataagtatggattactttatatgaagacaaattcttttaatggttgattaagttaggccggcttatgtgagcgttgtgagggttagacaaggcagagggatcaaaatctatgaatgcatgacttctcatgtctcccgtccttcacattcctacctttctctagtaggatgtttgtagaccattagaacataaaccagtggttgttagctacaactatatgttggggtaacccgggttccaatttccaatttagtggattagaatctccagggatgggacgtgagcatctgtattttttttaatctatagaatgattctaatatataaccgtggttggaaaatattaccatgaaccacagacatagattatcagatgcttttatattttcctttttgtccaaactacacagaaattataaaaactagcttttacacagagtcaacaaaggagctagtgttagcatgattgaagtagtaagattcaatagtagaaagttctcaaaaatgctggggttgtttcagatagcatcttgggggacaggtacagaaagctaatgttatgcttcagggcttcactattgcctacaggccttttctctaatcaagaatgccatgtcccccatttgtcttttctctacctttacgcaagagtgaaatgttcatataattaataatacatacctgaatagtacctttaagagtcttcaaacattatttttacatttttaaatttggccttaaacaccattatgtaaaataggtaaagaaggaattatcattcctaatttatggataaggaaacaaatttagagattaattgtctaaggttgtataactagtaagtaacaaagataagacttgaacccaagtctttatactccaaatctacattgcctccctagaggatatactcaatacaagtttaccaaagtatacttctcaatccccttcaccccaaaataactttacatttcttaatgccctttttaatctaatagtatatggatgttttacataattctaatttttatgtattatacatacaattttaagttttacctcagtttttcctttatttacagtgatcagattttaataaacagtcatgtaaaaactcatgaagttgctatgccatgatatgccgttcccatgtttaggttacctctagttttacacttgtgactaaagctactataagtactcttctatatggagctttcttcctcttttgaattactatcttaggatgaactctcagaaataggattatgggttagagggcatggacactcttatagctcttgttatgcgttgccagattgccctccaaaaagattgaagcagtttactcactcagttattttgaagggggctgaatcaatgctcatggctacagtgtttttactgcctttcagagcaggtgattgatgtttcttggatgatggactcttaggaagtgattttctttttctctatcacagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacaggtaggcaaacctgttgttttctcaatagagaaatgtttttactccaacctgatgacattcagaggtctttgaggagccacggtcactttcttgtgccctcttcctcatacttcttttttgggccccctttgtagcggctctgagctctgtttgcaaaagaagtaggccgcaggaagacctctgtctttcaccatgtgtttttggtttgtgttagagggtaaagttgcctggaactcaggaggctttatgcttttccctgaaaggccctgaagcataccattagcatcatatttcaaatttctgatcacagtgctttttgtagctttaaggacttaataagaaactattggatggcatatcctttctgaactattgaggaaaagagatttggttttagttttactttgcttttgctattcacctataggaaaataagaaagtgaaacttttactcctacatttttcttattttcttaataaatcttcttccaggaaattatccacattcaaaaatacaaactattgaaagtgtcccaaatgttgcccgtattaacagtaggagcacataagtgaaggacaggcactgttggcagtaaaaaaattttcaaaacatataatagctgttttcattctgttagccactgggaggagatgcaaaagaaaaatatccagggctttctaagaagattctaattttaaaaattatggattgctgtcagtccatgtatctaaaaatgtgttcccttttaggcatagacctctagcctcagaaaacttagtctatttgaattaagtcgccttagaaagaaatcatgatcaaatgcaggataaaagaatacaagctgaaattagtagtactagaaggagtcagaccaaagctctactacggtgatttgtgttaacatttgtctattaataggtatgactcaatagatgaatgattatatttaacttttagaaattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatc

SEQ ID NO: 1234 - DNA, 452 bp, mus musculus
tggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggcc

SEQ ID NO: 1235 - DNA, 596398 bp, mus musculus
tgagcttgagcgtgagccggctgctgaagacttgcgaacagttcggagccagcgagagcgcgccagagagagcgagagtgagggagtgagtgcgaggggatctagaggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccaggtgagacactcgtttcttggctctcccacttctcttacccctttggcctcttctgcatgcctcaccaccctcatccaactttgtttgtagagtgagtcttaactagtttgcctctattcttcacgctgtaaatcggtggggaaagaggactagaagctttcattaatgctggtgccttctagtccacgctcagtgcaagggcttcggtctaaaaaagtcccgcaaacttgagtttgcagtcctctattgaaactttccagccttttgcccatatcttgcatggcttttggctgttcgtggttatttgttaatttctctatttggttttctttcctgctcttttgtggccgcacgggtcggataggttttcttctgaacacggataccaagggctttctctgggggctggctgagctgtaaactgggctcctaagctggcaagccagaacacagcatttggggcatgcagggggtgggaagtctagaatccatcccagagggtgattcgatccccatcccgtgtgtttgttgtgagaatgtgtggggtgtgtggtgttgttgtttgtggtggtgttggtgtgtatgtgtgcaagtgcgcgtgagaacgtatgctcatgcttgctgcgcaaagctccccagtacacgatacaggaaagtcgatggatactatttttacaaaaggacgacgacaaatatcactttcctgggatcgtccgttttgggttatctgcagagggcaatgtggggcatgaaccactgtggctgggactggattggaggttggtgtacaagttggcagatttctagagaggatgctctcagctcttccaggcgaacagttggaaggatcccattcccttaaagacaggattccttaaatgatgatggccagcttccctggttgtaagtgtacctccttcatatcacagtttagaagtacactagtgaataaatgtccatttgtatatgagaagcaaattgtgttcaatgtttctgagtttaaaaagaaaaaaagtatactcaagattatctgactttttaaacgcctgtgaattagtcttctagtgtttattccatctccagtttggtaacatctcaggaaagcacagatttggcacaaaaatcaccatcacgtggttaaaaggagcaaaggattttgttgtaaaacagcactactgcttattattttgcaaaaataaaataaaaaaccaacaactttctcaaaatgaactttaaatcataaaatctctgggtctgtgaactaaaactgtaacagtttgccacatctgttgtaaaatccaaattgccatgtatagttgaatgatactgacaacttgtaggcaaactgttgcttactgctgcaataagataatgctgcagaacttacaagggaagctttttccttcttcttttttttcttcaattgagcagtgtttttctgtgttcaagcaattaaacagaaaactatttatgtgagaactcctacctgattcatatttagggcttacaaagctggtttattatatcagcttttcttaaggaagatagatggcctgaaaacacaaaggataacagctccctcaataaaacaggcaattatggattgtaagagtaaaaagacaattttatttcgactacaaagcattttattagtacacaaactaaaaaggttacaagggacttcagatagtggccatctaattcatttgttgccatccaaaaacactcaaacatttaaataattgcagacatgaaaacctattctcttattaactctctctctttatcagtctctcatctctccatccctgttctttctctcttccccctctcccatctctaaaaatgcccattcttaaagtggaacaattattacacttaggaaattcttccttcctcaattaatttgcacattcttgagaaaaacctatgaccatgattttcaaataaatagattagtattttaatatgattttgatacttttctctataaatggaaacttttcctaatttttattagagctacttactaaaaaaaaaaatccagaggcaggtgatcttgtaatatttttggaccctgttataccatgtatttttaggttattattttatctaattagcttttatttactgcttatcacagcaatagtaacttttcatgtgtgtgaattgcttttgtgtatgtgtgtgtataaaggtgatagagaaatattaaatatgtaggaagaaatagatctgtgatgtgattcatgtggcttctattgcattttcttttctttacgggtatttggtttattatattcatattttaaaactgtgttacaagtattgcaattttattaattgtaaaaatttatgaagtatattctatgaatgcaatccatcagtgaagatgaggaaaactactagaaacacacctaaattgcaattttagatagaagacaaccacaatttccgggaaaaatctaattaattataaaatgatatcaacaaattttgctgattcgaagtgccctcctaaccacattattaaaattacaaaatataataatgcatttaataaatgctttatgatgttaggtaagattatttacagaaatgtatactttaagttactcccaaaatctgaatttttaaagaaaattgcaaaatttttagatcaacattatttctgtgacttttctactcagtgaaaagaaaggtaagggatgtaaacaggaaagaggtccaagagagacaaagtaaggtagatgagactcgaggccagtgagagagtagaaatgcaggaaaagagcagagtgatgccttgagacagagtgaaagatggaacagaagagcttatagagatgccccaagatgagtgatgtaccaatggagatctggctaaagaggattgtccttcaggactcatgacttcttagtgcttctagctaagagcagggagggaagtgcaaggaaaaagtaaatgtttagcgaatagaaactcttaaacactattcttatttcaaagaagagattcatcttcatcgcttgatggataaatgttcataatatgttgttgaatggaaggcctatttgtaatggtgtcattggcaattttctctttctgtataataaacatttcttcccctctctgttgagtatgtggggaagagtacaagtcctgacttagagcatttggaatgctttctgtgctatcccagaaaacacaaagtggactgttttcaaattgttcattttcaaagaccttaaggtattgccactaagtgacattttgatttgcttcagtgcccattatgtgcactgaagaaaaatgaatgagtaaaatatatacataattgtttctttgatagtactgaaagtcacagcaagaactaccagtgccttttattaactattttgttgttagccaattataaaaatattcagttgtcttcctggaaaataagttaagaaataatatctgcttcaactgctagagaggtagtaagattaaaactcttgaccattcattgttctgttcgacaagtcaaggtttacatcactgtaatttcaaagaactgtacaacatttttccttcatgactgttaacttccaaaattaattataaggatatgattttgaggattattttttaaatgatgataaaaataatcaacactaaatgggaaaaattactatactgttttggattttgttttttgcagataaagcactgtgatttctgtttaatattttgtgcaagaaaacttagagtttttaataccagagagaacaggcaggtttagaaagtaaatgttgacaattttcactcttatgcaatagatttttcttactaaattctcctaagtttaatgaagcagtaaaatagtaaattaaaaattgtttttcctaaatatgaaaattactaaacaatcaataaattttagtgtttctctttttacctacctatcaacataaaagtaaaatattgtcagatttcatgaccagcatttaattttgtttgaggaccaactgattaatgttattcggtcatttagagttaaatgggtgcttgaagaaacaagaaagtatgattaagaaaatattttagtaatgcatttggagacatgattcaacatatattcaaacaaatagaattcagtttttaaagtaaaatttccaattgtggtttcttgttattttgatagtatataaacagaacataaatatggttttatattaaagagatttttaatatcaaagcacattttacaacattttaaaactattttcaaatactagaaatatggttattatgagcgctcaatgagtttggctttgtagtcacacttgatgagtactttatagttcatgatccatacagagtagcataatttactttgaaaatttatgttttacatttacagttaggcaatgtcaaatttttgcagaacttgaatcactttcctgagttaatattttgtatggcttacattttcagtaatgataaaaacattttagaaaagaatctgtgtagtaaatgcacattttattctataggacaatgaagagatagtcatattgtctgttaaaagcagccacatggtcaacaatgctctgtcctttatgagaagaatgatgtcaggattataattaaagcaattataattatatgccaatgcatagactttccatgtttacattcattttaaatatacgcttctgaataaccaacagttttgtatttaactactttagctggtattcatatgtgcctcactcatttattaggtgatggttactacattaaagaaatgatccatgacatgatgcagtatatctttggatttttatgtatcatattatcctcaatgtatagcacatgaatgtcaataaataattaggacatgatggtcttcagacattaatgttttatatggttttacacaggaaatacctagttcctatagaagatatcaagtctgaattatttgatgctttcttaggtaaccttattttgtcttaatgaaattcatagatgtctttaacatgcttctagcagacaaatataattgtgaaaagcctaatcacaacatgttatatttcagttgggaatctagctatccagtggcactttatcttatgcatttagagatacaaatgatttggggttatctactctatacattttaaatatgtattaaaaccatcctaattgatccaaaactgaaaatattatgtttttgtgaaaaagacatcaaacctttccctcaaagcaaaacaattaggtattaatgatattcttgttgtatattcaaaaagcctttggttgcatttatttcctccttttcttccctttcaccatctcaacctgcaaaactcttcactgtcacttcagatcacacaattctaaaaagataaaacaacatttaaacacatttgctttggacgggaaattgagcatttgtacccaataagcctgattgtggaactgcatgcaaattgtgttttgatttatctcttttacacttttttccatttgaattgatcttgcattaatttcaccaagcggctctgtgaggctgcagatgttgccctgtgtttaataaatcaatgagacagatctgaatgaatcacttcagatggattctctgctcggtttgatgtctagatgttattcttagcttgttatcatgacagatgcattaatgttcccatacactgccagcaatgtcaaagagattgaagcttttaaagtggcggcatccctttttccattttctgctagaacaactaaatttattttatttgagaatcagagaaaaataccaaatcaatcttaagatttttcatgggaaagagtctcaatactcatgctatattgtgaactattccaaaatggtggagatcaacatattaaagcctaaatatagtgtagctgcttaatagtgcctctacattaatatttaatcataggaggaaaaatgagaattagtaatatatgattgggacacattgaaagtgtcactataaatagaataatactgtatccaaattgattacagaagggtgttagtttttaaatccttactaataagctttttgttggcttaatgcagctgcaatatactcttatgaagggatttagaaccccttcaggatttaatattttttttagtagaaaggagacagcctgtccattgtgtattcatcatttattcacttggtaatgctgaaaatcccaggaaaatttatttcattttaatatatttatattcttgctaattatttgtaagtcataaattatccagtagcaataaatgcttttatagtttaatttcttaaactacagaaacgcatatggtcaccaaaaggaactttgatataacgctagtgaaatttattacttacctgcattaaatatcataactaccgtacttcatttcatttaacccatggctttgtttccttgattctgagagagaaacaatgctgtcaattgatgtgaaatattttgaatttaatattgtaggtgatataacttttcagttagtctgatatttgaaaatgcaaattttaaaaaggaggttcaaattttctcttattcagctttctgaagaatatatattttaaaaatcagtttttagatgtagatcctctttgaaagcctacacagtattccttaatcataattttattcctacctttattagaataggaaaacagtaaacaccgttaaatgatactatttagatctcaaattcaggaaaaattgtatctccagtggttaggctaatgttggatgtttatgatatgtatactattacctatggtagagtttaaagaaaagttgaaaatgaacttcaataaattatggaaaatagttaactttttttcaatttttctttaaaatgtgtaaatgcctttatggtggtatctcaccacatccttcttcaacactaaatttgtatgttaaaattggtgaaaatattatactgagactgtgaatttaagaagtaacacaaattgttttatgcaaaattgaatatgttttaagaaaaagatatctttatcaatacctatcatggtatccttaaaaaagaactgaatttgttacataaaacaaaaccttgggtttttaataataatttctgaggagtcatttttaactccagtaacgttctttgaaaaggttcattaagcctaatgttctgtgtatattagacatttaattcacatttgttgaatgaatacaactatgcatacacatatacacacgtttattcctcttattagaattctttgcagtatatgacgttccttaacaaaaggtaagaaatagttaaagtatgcagttattgaagatatactaatcctgaaattttaaatccaatataaaacaatttgtaatcatgccataaacctttcacaaatacacatgtaaaggtatcaaaatctaatatatgaacttagaatatttgaaatgaagtatatcttcaaagcaagtatgacttcttgatatttcccttaggtgaaaacccagtagagatgctcaaatattatgaaaaggcaataattaatgaataaagtgagcctaagaccataaaatgattattggtgatttagatttatactacttgatatgaacactaacccttgtggcagttgacttgtgatcctgttttcaaacagtaaatgcatgtgtattcaaaatgagttggtaaaaggagggttttcctcccttctttctagtctgtgaatagaatacaaatacatgttaaaaagaatgatttgatttttttcctgaataatcttaaggcccaatccaatgaaactcaaatttgcatgaagtatcctcctcaccacccatttaaaagaataacttagttctttcaggtgtaattaattttgaagagtaaaatttcctttaatctaggaaccctgaagttgaaactactcgtatctgtgtactattttgacccatcacaattactttgtttattagagcaaattgtggtggaaactttgtaattatactactggaaaaagtatatggtacaggaaagttaaaaaataataagccacagtatttttattgctatataatatttttatttttaaacaaattgactgtttaatggtgtgtaatgtagtgtgtatacaaaggtatatagcattcgattgcaattgtgtacaatgatcttatcaggttgctggcaactactagctagtaacagcatttgggctacatttagtctatctgctatttatgtgatgggttaaaaagaaaaaagtaatattgatctgtcgccggattaaagtttgaaatgggcaacagcctgaacacaaaagccttttttttatgatttctcagcttgccattgatctagttttattgcattcattatttattaaaagaatttgcaagctaaacataacgttaagctagtttgcacacagggaccgcacttaggaaattgaatggaaattgcattagagatgaacatctgtgctatttttccactcatgtgtttatgggtttgtataaaaggtgtattggattaacagttataaccattatagcttacagcaatatgttagtttctgagctttcagttattttgagagaagtctatctctcatgtttgtctaaaaagtatagtactatcatcacaaacaatattaattatgtatttatttttacgaacagtatttagaaaaatttatttttattatcatattgttaatgcattatgtatgttatgtatacattatgagatatcctgctatactgaagtaaaaacattttgaaaacatatgtaattatcatataagactatactatctcttaatggcctttggtagcagggtatataggtgcaattacagagcacctattttaagaatcttgagtttaatgccatattaaagcatactaaattcacagaaactatataaaaactttaatatgataaaaaagatcatccataaaatattatatatgtagtcaaagccttgatcattctaaaatgatagtaaatgcgcagacactgaagacttgctctatataacactactgatgataagatgggatgcattatgatatggttccccttttgggttcaatccaaggaagtttaattaccaaaccgcaagttgacctccccagaggacataagttagacgtcagtgagtatgggttttttttgtgtatgtgtgttttgtttttgtttttgtttgggacaaggtctggctctgtcacccaggcaggagtgcagtggcaaccagtgagtatgtcttttgctgtattgtctttaagctgtagacatttggaaaattcatgtctatctatttaattattggaatttaaataaaaacttcttcacaaccattttgatcgctcatgattagatttgttatgatagcctgtgcgtgtgtgtgtgtgtgtgtgtgtgtgtctatccagtacttattaagggtattctttgtggtgccaggcagtggtctaggtgctaggtgctgtgaacgaaatgaacaaaacggtctgttctttcatggaccatacagactaccatcatcctatcattagcttggggtgtataagctgtattatccctcctagtatatttactaaattatgaaatatttgagattacaaaattttgccacatctattattgaataatccttaaatttcctttcctatatctgcctcatgcattatatcagtaaacattagacttttttcagtcttcggaattataccagaaaagtccaactaaaaatagttattaagatacaaaacaaggtattttagttttatgagtgcagaaagtgttcttatcttataaagtacacataaaaaggagcatgaaataaaacatgtatttccacttaagaatgaccatagttaattgaccttagtaactttttatgatatatatttgttaaaagggatatgaattcttaaaattcataaagttaatcaatccatgagacacacgtttttgttataaaacatgcaactgtggatttttaaaaaaattatgttaaaaagcttgctttgatttgtgttaagagttttaaactagtaagatcctcaatcttagagcatcatttgctttgcatgtggtcctatacaatattatgccaaaaattaaaacagagatgagagttgtttatttttgttcatccagagtacattgacccttaaatatgttatatttaaatgtaaataactttacaaaaccagattatttgcaaacatgtataattaaatgtttaatgttactgttaagcttgctgctttgaaaatatcctgtaatctgctaaacttctaaatttattttgtagaaaaatctgtgagttccctctaggtttttatctgaggtatgcaaaaggggaatttgttcatagaaaaaaaattactccatagtacattttatgcaaagcatacaatctttaggtctcactttataagccaattagcatattcactttaaacatgatattttccaattcaattcatttcaacaaatatttagtaagcacctactatgtgcaaggctccttatcaggggaagtggtgatactaagaacttgccacattcttattgtctcatctccagattatctaggttgagttttattgtttcatggttaactctcagctaacctacattagtggaaggaagagtaaacaatacatataattcaaaaacgtggaaaattaaaataacattgatttggctttgcagtgcattataaaatgttctcagcatatttacctgtctaaatatattttacttattctaatattaaattttatttacttttttctgattaaactctcttttaatgggtctacaaaattgtgtgacagattttgatcaagttgtttccattaaaaagtactgattttaaaaactaataacttaaaactgccacatgtaaaaaaaaaaacaaaaaaaacaaagtgttccacaaaacattctgccttccttctaaagattttacaatgcattgttatcattaaccagtcttttactattaaacttaaatggcccattgaaacaaacagttcaaagattcttcttccaccactgattaagactagggtggcaggtattagggataatattcatttagccttctgagctttctgggcagacttggtgaccttgccagctccagcagccttctgatccactgccttgatgacacccacagcaactgtctgtctcatatcacaaacaccaaagtgacccagaggaggatagtctgagaagctctcaatacacatgaggttgccaggaaccatatcaatgatggcagcatcaccggacttcaagaatttagagccatcttccagcttcttaccagaacggtgatcaatcttttccttcagtacagcaaacttgcatgcagtgtgagccatgtggcaatccagtacaggagtatagccagcactgatttggcctggatggttcaggatgatcacctgagcagtgatgccggctgctttcattggtgggccatttttgctgtcaccagcaatgttgccacaacgaacatccttgacagacacattcttgatattgaagccctcattgttcccaggaataaagctttatttcatttcactcgaagctttattttatttcactcaaagcttcctggtgcatttcaacagactttatttcagttgtaacatcgactgcagcaaaggagaccaccataccgggtttgagaacaccagtcttcacttgaccaccaagtacagtaccaatgccaccaattttgtggacatcctggagaggcaggcgcaagggcttgtcagttggaccagatggtggtaggatgtagtccagagcctcaagcagcgtggttccactggcattgccatctttacaggtgactttccatcccttgaacgaaggcacgttagcagttgcctccagcatgttgtcatcattccaaccagaaattggcacaaatgctactgtgttggggttgtagccaattttcttaatgtaagtgctgacttccttaacgatttcctcatatctcttctggctgcagggtggctcagtggaatccattttgttaacaccaacaattagttgtttcacatccagtgtgtaagccagaagggcatgctcactggtctgcccattcttggagataccagcttcaaattcaccaacaccagcagcaacaatcaggacagcacagtcaacctgagatgtccctgtaatcacgttcttaatggatacagtagtcattacaggtgttagcagatcaaaacctggcaaattacatgaggccagttactgactttaacacaccttcctgtgttcagaacccctaaataaccatcttccttcagttaaataaaaatttcttgacaccagaggaattatagctttggattagaatgcattgatgagtataactctaaatcagatttttgtgaagcgtttctactctgtgaagagaataattaattgattttcagcttgcaattaagaaaaggaacattatatagtcttgatgctgattatatcctgtcaagagcagtcattttcatgatgggcacatatagaacattgtgacctctaaagagagtagtaactgctccagtgtttaattggtatacgtacatttgatatagccacattcttaaatttgcagttcttttgcgttgttccttgtcatgctagaggactgacaggtttttgttattttaggggcatgttcttttttgtaaagtcgtatgatgtttacataatccctattctgccacaatctaaagcttttattattcttccttgttttaaagtgaaagcaagtttatcaagaaagtaaaggaataaaggaatgactactccataggcagagcagcctaaagctttcattattctttacagttttgtctcattgaattgaatgacagatatgctgtgtattcagtttggtattttgtttcttttttttttatttttgtttttttgtttccaagatggttctcagtttttaaatgtaaataaaatccaagaattccttttttttgaggtctttctctacattagtgggaaatatgtaaaagcctttgtcccatatggattcatgttccttcaaagaaggggcagtgaagctcaataatttagttttctgtttagttaggaagcctcttgattttacagacaggtggactaaatttgggtcatgttagcattgatggagttctatttgggaatgaacaaaggaatgaaactaaaaaagggtggagaaaacctgatgagaaaatgtttcttatgtaaatagagaatagaccaggaactaactgataggtgggaagtaggcagtatagagtgtactgatagaggcatatccatagagttcttgaatgaattatcccttttaattgtcttcattttagtggtaagattaatcagattaataatgaacaggaacaaaggacatacaaatattagctgtgaataaaaagaaaaaaaactgaaggcaaaatgtagaaatgttattccatttgaggtggcattaaaaaccttaataaaacatttgtatacgtgttgtattaaagtaatattcatttagtattcttgtaaatgttactttaattaaaaaattataaagtgtccatttacatatccttggtaaatgttcttactattcctgttctgtttgattgattctagcttgccataacacatttttgaaacgtgttgagaataaattatttatatttttgtatatacacttttttaggtaaaagtttatttttaagttattttttaaaatttttgtggttacatagtagatgtatgtatttatggggtacatgagatatttttatataggcatgcaatgtgaaataaccacatcatggagagtggggtatccctccactcaagcatttattctttgagttataaacaatttaattacactctaagttattttaaaaagtacagttaagttcttattgactctagtcaccctattgtactatcaaatagtaggtcttattcattccctctattttttttgtacccattaaccatccccaccttccctccagcccttcactattcttccaaacctctggtaaccatccttctactttctgtgtttattagttcaattgttttgattttaagatcccacaaataagtgagaacatgtgatgtgtgtcttcctgtgcctggattatttcacttcgcataatgatctccagttccatgcatgttgttgcaaatgactgggtctcactcttttttatggctaatagtactccgttgtgtgtatgtaccacattttcttttttttaatgtttattttaggttcaggaatacctgtgaaggtttgtaacctaggtaaactcatgtgactgggatttgttatacagattatttcgtcacccaggaattaagcccagtacccaataataatcttttctgcttctctttctcctcccacctccccactcaagtatatcccaatgtctgttgtttacttttttgtgttcataagttctcatcatttagctcctacttataagtgagaatatgtggtatttggttttctgttcttgcattggtttgctgaggataatagcctccagcctcccacaaaagacacaatctcatcgttttttatggctgcataatattccgtggtgtatatgtatcacttttttttaatccatttctgtcatcgatgggcatgtatgttgattctatgtctttgctattgtgaatagcgctgcaatgaacagacacgtgcatgtgtctttataataaaacagattatattccgttggttatatacccagtactgggattgctgggtcaaatggtagttctgcttttcgctctttgaggaatcaccaaactgttttacacaatggttgaactaatttacactctgcccaacagtgtataagtgttcccttttctccgcaacctcaccagcatgttatttatttatttattttttgctttctagtaatagccattctgactggtgtgagatggtatctcattgtggttttgatttggtttctctaatgatcagtgatattgagcttttttcatatgcttgttggccacatgtctgtcttcttttgaaaagtgtctgttcaggtcctttgctcagtttttaatggagtggtttgtttttttcttgtaaatttgcttaagttccttatagatatttgatattacctttatcaaatgcatagtttgtgaatattttctcccattctgtaggttgtctgtttatgctgttgatagtttcttttgctgtgcagaagctcttaaatttaattagattccacttgtcaatttttgcttttgttgcgattgcctttggtgtctttgtcatgaaatctttgcccgttcctatgtccaggatggtattgactaggttgtcttccaggattttaatagttttgggttttccatttaagtctttaatccatcctgagttgagtttagtatatggtgtaaggagggggtccagcttcagtcttctgcatatgtctagccagttatcccagcaccatttattgaatagggagtcttttgctcattgcttgtccttgttaggtttgtcaaagatcaggtggttgtaggtgtgaggccttatttttgggttctgtattctgttccattggtctgtgtgtctgttcttgtaccagtaccatgctgttttggttactgtagtcctgtagtatagtatgaagttgggtaatgtgatgcctccggctttgttctttttacttaggaatgccttggctatttgggctcctttttggttctatataaattttaaaatagtttttttttctagttttgtgaagaacgtcattggtagtttgataggaatagcattgaatctgtaaattgctttgggcattgtggccattttaatgatattgattattttgacccataagcatgggatgtttttccatttgtatcttttctgattttttttgagcagtgttttctaattctcattgtagagacctttcacctccctggttcactgtattcgtaggtattttattctttttggggcaattgtgtaccacattttctttatccattcatccattgatggaacttacgttgcttccaaatcttagctatcgtaaacagtgctgtaatgaacaagggagtgcaggtatctcttcgatatactgatttcctttcttttgtgtatatactctgcagtggtattgcgggatcatacggtagctcaaattttagatttttgaggaccctccaaattgttctccatagttattgtactaatttacatttccgccaacaatgtacgaaggtccccttttctctacatcctcaccagtatttattattgcctgtcctttggatataagcgatttaaattggggtgagagggtatctcattgtaatttcgatttgcatttctctgatgacaaatgatgttgggcaccttttcatatgcctgtttgccattggtatgtcttcctttgagaaatgtcttctcaaatctttttcttatttttttgattggattattagatttttttcatatatagttgtttgagctccttatatattctgattattaataccttgtcacatgggtagtttgcaaatattttcttctattttgtgggttgtctcttcactttgttaaatgtatcctttgctgtgcagaagctttttaactggatgcaatcccatttgtctatttttgctttggttgcctatacttgtggggtattgctcaagaaatctttgcccagaccaatatcctggagatctttcccaaagttttcttgtagcagtttcacagttcaaagtcttaggtttaagtctttaatccattttgatttgatttttgcatatggtgagacataggaatctagtttcattcctctgtatatacatttccacctttcccagcactctttattgaagagatcgtcttttccccagggtatatttttggcacctttgttgaaaatgagtttactgtaggtttgtggatttgtttctgggttctctattctgttccattggtgtatatgtctgtttttatgccagtaacatgctgttttggttccttatagctctatagtataatttgaagtaaggtaataaaactcttctagttttgcttttttggttagaatagatttggttattctgggtcttttgtggttccatataagttttagaattttttctttttcagattgttcactgttggcatatagaaatgctactgatatttgtacgttgattttgtattctgtaactttacttaatttgtttatcagttctaacaactttcttgtggagtctttatgtttttccaaatataagatcatatcatctgcaaacaaggataatttgacttctccctttttaatttggctgccctttatatttttctcttgtctgattgctctagctaggccttccagtactatgttgaataacagtgatgacagtgggcatcattgtcgtgttccagatcttaaaagaaaagctttcagtttttccccatttagtatgatactagctgtgggtctgtcatatatggcttttattttgttgagatatattccttctatccccagttttttgaggctttttaccatgaagggatgttggactcaccaaatactcttctagcattatttgaaatgattacatagtttttattctttattctgttgacatgatgtgtcaaaacgattgatttgtatatgctgaaccagccttgcatcccagcgataaatcccatttggtcatgttgatctttctaatgtattcctgaatttgttttgatagtattttgctgaggatttttgcatcaaattcataggagatattggattgtagttttcattttttgatgtgtttttgtctggttttggtatcaggttaatactggcctcataaattcagtttggaagtattccctcctcttctatttttcggaatagtttgagtagtattgggtttcgttctttttaaaatgtttggtagaatttatcagtgaaggcttcacgtcccaagcttttcttcactgggggaatttttattactgcttcaatatcattacttgttattgaactgttcaggttttggatttctttctgtttcaatcttggtatgtatgtatctaggaatttgttcatttcttttagattttccaatttattgccatatagttgctcatagtagccatgaatgatcctttgaatttctgcagtatccattgtaatgtctccttttttcattgctaattgtatttattgggattttctctctttttttcttaattagtctggctaaaggtttgtcagttttgtttaacaaatcaatttttttgttttatagatcttttgttttctaaaatttcaattttatttctttcccaattttcattatttattttcctctactaattttgagtttgatttgctcttgctttttaaattcttttaggtgtaatgttagatagtttatttgaagtttttcttcttttttgatgtacgcacttacagctataaacttgcctcttattattgcttttgctgaatcccatagttttggtattttgtggttctattatttgtttcagtacaattttagtttgcttcttaatttctttattgacccactggtcgttcaggagtatattgcttaatttccatgtatttgtatagtttccaaaattcttcttgatattaatttctagttttattccattgtagtcagagaagatgtttgatattatttcaagttttttgaatgttttaagacatgttttgtgatttaacatatggtctgtccttgagaatgatccatgtgctgaggaaaataatgtgtatcccgcagctcttggatgaaatattctacaattgtctattagatccatttggtctaaagtgcagattaagtctgatgtttcattttggattttctgtctggaagatctgtgcaatgttgaaagtaaggtgttgaaatcttattattcaatttgggtttatctctctgtttagctctaatcatattttctttatatggctggatgctccattattgggtgcacagttatttacaattgttttatcctcttgctgaattgacccctttatcattatatagtgaccttccttgtctctttttatagattttgtcttgagatttattttgtctgatataaatatagtgactcccttgcttctttggtttccattgacatggaatattttttcctatccctttagcttcagtctttgtgtgtatttataggtgaagtgtgtttcttgtgggcaacggatcaatgggtcttgttttttcatccattcaaacactctatgtgttttgatcagagagtttagtctatttacattcagtgttcttgataaggacttctgccattttgttatttgttttcttgtcttttttttccttcctttcttcgtctagtaaggtgactttctcggtgatataattcagttttttgctttttattttttgtgtctcttttgcatgtcttttggtttgagtttaccatgagctttgcaaatactatcttataacccattattttaagctgaaaaaactacactttgcattaaaaaaagacaactaataaaaaccctatgccgtaactttgtccccttgctttttaaccttttgttttttctatttatattttattgtactgactatgtcttgaaatgttgtgttattgtttttcattggttcgttgtttagtcttttcacttaggataatagtagtttacacaccacatttacagtgttacaatattctgtgtttttttgtgtgcttattattaccagtgcattttgtaccttccaaacccttacttattgttctttaatgtccttttctttctgattgaagtattccctttagcattgcttataagataggtctgatgttgataaaatccctcagcttttgtttgtctgggaaagtctttaattctcctttgtgtttgaaggatatttttactggatatactattctatggtaaaagcatttttccttcagccctttaaatatgttctgccactttctcccggcctgtaaggtttccactgaatagtctgttgcctgacatattgcagctccattttatgtcattttttcctcttactgcttttaggatcctttctttttcctttgggagtttgattattaaatgcattgagatagtcttctttgtgttacattggcttggtgttctataacattcttgtacttgtatattgatatctttctctaggtttgagacattctccattatctttttgaataaactttctacacttatctctacccctgtcttctctttaaggccagtagctcttagacttgcccttttaatgctgttttctagatccagtaggtatgcttcattgtttcgtattctctttttttgtctcctctgtgtattttcaaatagcctgtcttcaagctcactgtctttcttctgcttgatcgattgcattttcaactcaaaaatttgtgcttgattattttcaattgttttaatttctttgttaaatgtatctgatagaattctgaattccttctttgcattatcttgaatttctttgggtttcctcaacacggctattttgaattctctatgttaatggtcacatacctgtttctccacaattggtccatggtgccttatttagttcatttggtgaagtcatgttttcctggatgatgttgatgctaatagatgttctttgatgtgtgggtgttgaagagttaggtatttgttgtagtcttcactgggcttatttgtccatcccaagaaggatggctttccaggcacttgaaaagacttgggtgttgtgatctaagctgtgtctgcttcaagggcaccccaagtctagtactgctgtggttcttgcagactcgtagaggtactgccttgatggtcttcgacaagatctgggagaattttctggattaccaggcacagactcttgttcttttctcttactttttcccaaacaaaaagcatctctctctctctgtctgttctgagccacctaaagctgggggtggagtgacacaagcacccctgttgccactaccgctatgactgcactgggtcagatctgaagtcatcacagcactggttcttacccaatttcggctgtaacaactccctggctactgtctctgttcgcttaaggccctagggttctacattcaacgggtgacaaagccagcatgacttgtgttcttcccttcaggacggcaaggtcctcttggcctagtgtgggcccagaggtgctgtcagggattcaggtactacagtcaaaacccttagaagtctacctggtgttctattgtattgtggctgagctggccctcaaatcacaagacttagtctttcccattctttttgcccctttgccaatgcaaaggaggctcactccatagctgctgccaccctaggccacaaggaggactgccagactactgttgatgttctcttaagtcccaaggactctttagtcagcttgtcgttgttaacccaaaatatctgagacaggtctcagtcaatttagaaagtttattttgccaaggctaagcatgcgcctgtgacacagcttcaggaggtcctgatgacatgtgcccaaggtgataagggcagagcttggttttctacattttagggagacgtgagacctcaatcaatatatttaagaggtacattggttcagtccagaaaggcaggacaacttgaagtagggaggggacttccagatcatagctaggtaagagacaaagggttgcattcttttgaatttctgatcagcctgttcaaaggaggcaatcagatatgcatctatctaagtgagcagagagatgactttgaatagaatgggaggctggttggccctatgcagctcccagcttgacttttccttttagtttaatgattttggggccccaagatttattttcttttcacatggtgaatggttccctatcctgctgtagctgagctggtattctaaatgcaagacaaagtcctttccactcttccctctcctctcctcaagtggaaggaaaggggtgtctctcagaaccaggagccatgcagcctggggttatgggaggggtgatgccagcactcctttggctgtcccagttggtctctcagtgtgtcatgcccatgccttcccccgcaaccacccccagtccatgtctctgggcctagttcagcagtaggacttgcctaagtgttgcagtctttatggcctagattgcctttcaaggttacttagagactgagagcactttggccctcagtggtgaggtttgctgatggctcaagtttggacagctgggattggggattcccctcttactagggctggtttaaatgcgccctctatgggcagctgtaagacgagtttggtctgggatttgtctgctctaacatgacagcactgagttcagtgcctcacaattgctgtgttctccctctcccagcacccagagatgctctctgacccacatgctgctgttgctgctgggggattggggaagggtagcattagcaattcaggacttttttctatctcttcggtgtctctttcagtgatatgaagttaaaattagatactatgagtgctcacttgatgtttggttcttatgaaggttttttttctgtgtagatagttgttaacttgcatagctttctattcggctaccttgctttgccttgagaatgaggtttttttaaaaggattaaaatttgcctttgggtacacgtgtgaagttcttattgtattcagtactaactaagttcgcatttcagggagtaatttgaacaactgcattcgaggttatttaatgaacattacaatttgaattcaagaacaccagcatgccatttttgttacttttgtaattaagtaaagtttaagtatttactacaacccttttgtctaaaactatatctgaaagtttaaattactatcaaggtttatagtttatatagtgctttcacatatactggctcattaaatctgatccttagaagtgtctgtttttataattttgtggtgaaatttctaaatttttataaataaatggctgattacaacaaggcatgtttggagatcacttaatctcatttagacttttttttactcaatgttaaatcagcatcatccattgtgataatgaagccgataatgcttctaggaagtaatagtatctcatggtctgcagcagttctcaggctgcaaggtgtattcacacactatctgaggttattctcacaacaatcctatgaggcaggtcaccccatctgaaatgtaagtgagaaaatggaaatgtaggcaagtaaaatgaattacctgaggcctcacagtctattacaggcagagccaattcttgaatctaagtcttctgttgtgcctcctctggtacattatcctctctatgctgtctcttgaatgatgggcttgagcaaacaaatttaattaggtggtggattgttctatatagtaagggaattatggaaaatctagtggtgggaattagggataaacaaagtagaagaagagagaagcactacacaggaatttcactgtaatttctttaaggtgcatgtcctgataggaaatactgccttttaatgatagtgtcttcagaaatacactaacaaagatcccttgaatggagactcaattccacatgcatttacagaaaggttttgggaatcaacaaaaacttaatagtttgaaagaaaaagtaaaaggacttataattcaagaaagtgtttagagacaacagcataatattgaagcataaaatttaagtataaaactgggatccagttactaggaaaatatgaattgtcccttgtgtccaaaatactatgctaggatctgtggatgctttcagaaagattttaatcttattgtagagaaaacatatacacatataaaaaagattatcattcattcatttactcatcaaatagttatcgggtgtactctgtgtcaggcactcttctaggtgcttgggatacatctattaaaaagaaacaggcaaagacctcttccgttgaaaaagagattatattctagtgtatggtattgtggatgtgggaagacaataaacaatatgcataccaaagtaggaaattatattacatgttagaagtggtaagtgctatggaaaaatagagcaagtagagcaaagtaagggtatgggaggattggagtcagttacagttttaaataggatgggcattgtaggcttcattaagtatgtgagatttgttcacagtcttgaaagggagaggagttaggcaagtagaatctggggaaagtgtctcaaactgagagaacagttggaccagaagccaggagcatacctggaaggtttgaggaatgttaagaagccttcaagagtgaatgaggggagagtgttcataatggagtaggaaagagatcataatggtaatattggggagttggccacatggatccttttaggccattttgaagactttggttttttcctgaatgaaatggattattgcagtgttttaagcaggagtataagaggatctgacttagattttgaaaggattgctctggctaggttgagaataggctcatataaggcaaaggtagaagcaggatgctattgcagtgaacaatgagagagatggcaatggcttagaccatagtggtagagtagaggtgataacaattggtcagagtctggataggttttgaaggtagaaccaacagcacttcatgatgaattagatgctgggtgtgagagaaagaaaagagtcacgaacaactccaggaatttggcatatacaactgggaggctgaagtttccttcatttagttgggggggaaggtggaggtagagtaggtcaggtggcagagttcaagagtacagttgtttttttttttttttttttttgagacagggtcttgctctgtcatccaggctggagtgcagtggcatgatcatcgctaactgtagccttgaattcccgagctcaagcgatcatactgcctcagcctcctgagtagctgggactacaggcaaacatcaccatggccaggtaatttaaataatttattttttagagacctgagtctcactatgttgcccaggctgttcttgaacttctggcctcaagcgatcctcctgccttcacctcccaaagtggtgggatcacaggtgttagccaccatgcccagcctatttttaaaaatctccctatgtagattgtaatattcttgatctcagatactatggttgatgatctttgtattctccataggacagagccttttgcccatagttgatggtcagcaaacatttgtagaataaatattgaactaagaaacttctgtgatgaggtgtgaagataaatgtagtctttatgggatcagtatgcaaactattagacataaattataagcatgtttgaaaagctttcttcaattcttttctttttctttttagagacaggttcttgctgtgttgcccaggctggagtgcagtggcatgatccatcatagttccttgcagccttgaactcctgggctcaagttatactcctgcctcagccccctgagcagctaggactacaggtacatgccaccatccccagttaattatttttaatttttttgtgtagagaaagaggtcttgctattttgcccaagctgatcttgaactcctgggctcaagtgattctcccacctcagcctccaaaagcactgggattacaggtgtaaaccaccatgcccagtgtcttttacctctttaagtagagatgtagagtaggcattagatatacaagttcagtgcttgggatagatgtctggacaggagatatatgcttaggagaggaatgactgtaaatagaaaagagtagagtttcaaggactgagtcctgggtcacactggcctaaagagatcagagagaagaggaggaatcagcaaagagcctgacaaagaacatccagtgagataagaggaaaagtaagagagaattatgttctgaaagctaatcaaaaacaacatatccacaatgagggaataatcagctgtgtcaaatgctgttaataagtcacatgagaattggcaattggatgtggcaatgaaagtcaatggtaatctctatgagaaaagttttgatagagaagtgggaatgaaaagtttgagtggcatgtgtttaagaaagaataagaggagaggaagtggagtatcaacaactctttccagggatttgctgcaaagatagcaaataacttagggttggcaggaagtagtgtgaaaacagtggatgtgaggggagggggtcatgaggttatttttttatcatggtggaagacataacagcatatgctattaggaataatcaagtaaaaatgaaattaatgttgtgtgacagaagagtattgctgaagtgatattcctgaataggaaagagtggatgggatccgatgtacaagtagaagtatcttcctttagacagaagcaagattagtgcatctacattaacaggtgggaaggcagagtatatagatggagattctagttgatacagtattgggtcgctgtggaagtcctcttctaattgtttcaattttctcaatgaagtgggcaacaaggtcatcatttcaaagtgaggattggaaaggaggtattgctgtgaaatagctatctgggtaagtattagagtaaattattaaaaaaactttagtatgattgccaggcaacattaagtgcccattaaggtcgtggtcataaattcaaaatggtcaatgtgattgtgtgttttaatttcaccacgtaaagctgtgtcagtactggtgcaaagtaggcaaataatagtatttaattagaattgtggttttgctaagcagtatgagtataacaaagcaagaggggcagaagaattgagggtttatgcaaaaggtgatgtagtgaatgagaatacattttaaatcatttaggtagaaagaagatatcaaggaggtgagaggcagtgatggtattttcaatgaactggaattccaagaaggggccaaaggattgttggagtactagaaggaatgaataaaagagatattggtggtcagagagtaggatgcaccaaattaagaatatggaagagttgcagttattggtaattaaaaaggttaggatatgggcttgagtgactgaagcgcagaggacaagacccttggaggagaggaggtcaagaaactgaaaggctagagtgttggtaatatcctccacgtgtgcattgtttattgaagttgctaaggattaagagagggtcaatgtatctaaaattttgtactatatataataatactatcagattttacgttgttaaacaatgattcttaatttctaaaatttaaaaattaaagttgttggaattaagaactctgagaacttgactgaaggtattgttttcaaactaatccacattcaccatgatatgaaggtttgaatatttatgctaataatctctgatttgtcatgggcatgctgtgcttcagtgaagctgtctgaagaatattgtgaaaataacattttccaaataattgaatatatttgctttacatcatttagtgttaacattattttccaatggaagactgtaatttattataaactgatttcatactggcaatgttattggtgtgtttgttgatcttattagtacgtcatatattcaggaagagtaaattaagttctcactcttgttttagcacattactattttaaagtttttggttttaattttcgtggctacatattaggtgtgtaatggggtacatgaggcattttgatacaggcgtacaatggataataatcacatcagagtaaatggggtatccatcacctcaagcatatgtcctttctttgtgttacaaataatccgattatactttcttagttaatctgaaatgtacaataaattattgttgactgtagtcaccctgtggcagcacataactatcttataaagagtactacaaatctgttagatacagtgaagaacttagaaatagtcatgatcctttactcatagatgcttcataatgcattcaaagtggcagaaaccaaatcagtatatatttttgacacctgctgttttctgagtcattcattattaacctcacatggaagctacttaaacagctcttgctgtagtcaccacttctcacagctagtctttgactactcttgggatttctgtgaccttagaggtttggtgatgaagaaatagttaagctttaaatcaggttctcatgtgaaatcattgcagagcaaagttgagaagttggctatctcaatcttgactccttgctgattacctaggaaacaaattttctctggtggggcttgtccagtcattcacctggcatcttaatagagtatttggaaaggaggttttggtcagcatttgcagactcccattagatcctatcactgattctgagtgaattttaatttctgcagctggagaatagtgagggaagccatatgtagtaacatctgctattaagactcttgtttagggagaaagaaggcagttttattgttaaaattttagttttgtgggattgatttaagaaatcttgtttcccttctttatctagcattgaaaagcgatatatgtatgcactaaacacggggttatctcaatcaggataggttgtcctaagtgttgtagaaagactgtttgaggcactatgaccctgacctctactatacaaaagcaaagtaaaacaaacaaacaaacaaaaaaacaaagtactcatccttcctgatatttgaaatccgatgacattagaacttcaaatgaatattttatcaaggaagaatcattggcaggtttgttaaaactgaatggaagtgcactgatgtaattgcctgaggaaactgttatcagaaaatgtgaggttgtgattcctttctaggagtaattgccctactcaagcttttgctcagaacaaccatctttaaagatctagctgaagtcttatcttctctatcaagacttctctcatggtgcgtggttgatcccttgcttctgtgaacttttatctgcagacagcctatctctttttttgtataaattgttaggatttaaagtgtttatgttttctctctccgaaaactagcttgtaaattcttcaacttcaggaacagtttgatatgtcattttatcattcacagtgccaaacatagtacatggatgtaagtactgaaaatgctttcagtttgttggtttgacagtgtaactatgatttattataattaaatgtatttattctgggaagtgttcatattttaagaaaatctattgctatactttaagggtatgtcagaataacatacccctaaatagaagcctagaaaattactgttttgtctcaggcacagttgttctgatattaatgctttctactttctagatgtatgaccatctaagcctcagttttttcatctaaaaatgggaataatattagctacataaatcatgaggtttttaagattaataagcctcatgtacataaagtgcttgacacaataagatcatagaacattagctcttatttctgaaattggtgctcacaccaagaaatgtgaacacacacatatatgtacattcataacacaagaaaaagagcaaattgcagaataaaatgaaacagttttcagaaatgtttgcaaccaagactaaattaactggttgactgaatgacactgtgtgcacttcattttctaggaaattcttgtatgttgactttctaggctgatatggcagctggtaggccatttattactagttctgttgtggaaaattcagtcttgtgtgtcatttagagtttgtgacacatgtaccctcccaaggcttaatgagttgtctgcagatggaccgttatttattacagtcatgtagaataaaattgattgtcttctaaaattaatttttcatttgcctccagccttgctttaatagggcacacacagttgcctgtttgcagaaatactgtttaatcacattaatatctcagccccccaggctgaagaagatagttgtatgaacgaacagcaaaatctgtatctttaccttctttttatgattaaattatgcaaataacttatctcctgcccttctaagcactaatcatctaattaggaatgatgtgttaaagcaatggttttgaatcaggagagagaagaatgcaggaagcagaaaatgggagctaacaatgaaaccactgaaggtacagtaatgtgtagtagatgaatctatgtatttgacacaagaagaggtgggaaggctaatacgtactatccatatacctgacacatgtcatctattggcaggaaatataattccttatctctgatgacaagttttttgatattaacttcacatttttagtaaggcaaatgttatatttcctgcatttttgagcactcaaggaaagtaggatatttattatctcacccaatgaaggagctggcttgctcttttaatccatgcaggataatatacggtaaagcaatgagattgcaccttgattgtgaacatacactaagttgttcagactattcctttaaagaaaagattgcttaacgaaaagcagtcctttcttttttcctgagaaattaatcagtcaggacatgcaaacccagaacaaatatagtccccttactgagggattcaggattcagttccaaagcatcattccaaatatgtatttgcaagatcttgccttgattttgtgcttctgcctccagacactgattgtgaagagtttttagcacattagtcctatttagttgcggacataattattacatttaatacatatattgtgtctttatccaacataattattatattaatagtaaccataataatgataaacaatactattaatgtcccctagcaaccatgctaaaccgtatatatatatatatatatatatatatatatggttcttatagtaatgtgaaataaatcatgataaatcagtaaatcaggccatagaaataatataagtttactgtagatgttttagaacctctcaaaattttttcttatgggtacatttgtgagagtcagcaatcataatgttcaggtccttttaatatagtcttattgatttgaattcagtgctttaacatttttacagtcaactctggagtattttaaaaaatataatgcaaaccatctcccgaggcatttgagaacaaaatttcaagaaatgtatccaaaatagaacataaacaaaaatttgtggattggaacagataaattttctcaagttcttgagaccagtgctgtcattctcttagtattgctagtttagcttattctcttacatgtgctggttcaggccactaagaagacccactgatcaccaccagctgctattctcttgaagtgtggcagacgcttactatattgatgccagctggttacagtcatttgttttacatcttttcttttttaagggtaggcatcaaactacagtctatctgtgtttacagggaaaaatgcttaatctatttattttgataatcgaagccaatgagtctaacgtattgaactttccaaggttgactttctgaaaattgttctggagaatttttggcacatgcattcctgtggaggatagttttttatagatttctacagtgaagacaacattgcctccatggttgcaccaaattccaaagggccaagttagcgtgtggaagtgaagggtgagtcccttagaacttattccattgctacctcatgaagctttatctcacttttctcaaactaacatgattattacatttccccaaacatagatggtgcattatcatgtcatatgattaaaaaaacccctaaagaactggctatgtccctgttagatgtcatatgtctgactgtctatctatctatctatctatctatctatctatctatttttcaaattatactttaagttctgggatacatgtgcagaacgtgaaggtttgttacataggtctacacatgccatggtggtttgctgcacccatcaacccgtcatctacattaggtatttctcctaatgctatctctcccctagcctcccaacccccgacaggccctggtgtgtgatgttctcctccctgtgttcatgtgttctcattgttcaactcccatttatgagtgaaaacatgcgatgtttggttttctgttcctgtgttagtttgctgagaatgacggtttccttcttcgttcatgtccctgaaaaggacgtgaactcatccttttttatggctgcatagtattccatggtgtatatgtgccacattttctttatccagtctatcattgatgggcatttgggttggttccaagtctttgctattgtgaacagtgccgcaataaacatacgtgtgcatgtgtctatatagtagagtgatttataatccttggggtatatacccagtaatgggattgctgggtcaaatggtatttctggttctagattcttgaggaatcaccacactgtcttccacaatggttgaattcatttacactcccaccaacagtgtaaaaatgttctatttttccacatcctctccagcatctgttgttttctgactttgtaatggtcaccattctaactggtgtgagatggtatctcattgtggttttgatttgcatttctctaatgaccagtgatgatgagctttttttcatatgttcattggcctcataaatgtcttcttttaagaagtgtctgttcatgtccttcacccactttttgatggggttgtttgtttttttcttgcaaatttgtttaagttccttgtagattctggatattagctctttgtcagatggacagattgcaaaaattttctcccattctgtaggttgcctgttcactctgatgatcatttctttggctgtgcagaaggtctttagtttaattagatccagtttgtcaattttggcttttgttgccattgcttttggtgttttagtcatgaagtctttgcccatgcctatgtcctgaatggtattgcctaggttttcttataggatttttatggttttaggttttacatttaagtctttaatccatcttgagttaatttttgtataaggtgtaaggaaggggtccagtttcagttttctgcatatggctagccagttttcccaacaccatttattaagtagggaatcctttccccattgcttgtttttgtcaggtttgtcaaagatcagatggctgtagatgtgtggcattatttctgaggcctctgttctgttccgttggtctacatatctgttttggtaccagtaccatgctgtcttggccttgtagtatagtttgaagtcaggtagcgtgatgcttccagctttgttctttttgcttcaaattttcttggctatacgggctcatttttggttccatatgaaatttaaagtagtttttcctaattctgtgaagaaagtcattggtagcttgatggggtagcattgaatctataaattactttggtcagtatggccattttcacgatattgatactttctatccatgagatggaatgtttttccatttgtttgtgtcctcttttatttcattgagcagtggtttgtagttctcctagaagaggtcgtctgcatgccttataagttgtattcctagatattttattctttttgtagcaattgtgaatgggagttcactcatgacttggttctttgtttctctattattggtgtataggaatacctgtgatttttgcacattgtgattttgtatcctgagactttgctgaagttgcttatcagcttaaggagatttggggctgagatgatggggttttctaaatgtacaatcatgtcatctgcaaacagagacaatttgacttcttctcttcctatttgaatcccctttatttctttctcttgcctgattgccctggccacaacttccaatactatgttgataggagtggtgagagagggcatccttgacttgtgctggttttcaaagggaatgcttccagcttttgcccattcagtgtgatattggctgtgggtttgtcataaatagctcttattattttgagatacgttgtgaatacctaatttattgagagtgtttagcatgacagtgtgttgaattttatcaaaggccttttctgcatctactaagataatcatgtggtttttgtcattggttctgtttatgtgatggattacatttattaatttgcatatgttgaaccagccttgcatcccagggatgaagctgacttgattgtggtggataagcttttggatgtgctgctggattcggtttgacggtattttattgaggatttttgcattggtgttcatcagggatattggcctgaaattttccttttttgttgtgtctctgccgggttttggtatcaggatgatgctggcctcataaaatgaattagggaggagtccctctttttctattgtttggaatagtttcagaaggaatggtaccagctcctctttgtacctctggtataattcgggtgtgaatccgtccggtcttgggctttttttggttggtaggctattaattactgcctcaatttcagaacttgttattgctctgttcaaggatttgacttcttcctggtttagacttgggagggtgtatgtgtccaggaatttatctatttcttctggattttccagtttatttgcatggaggtgtttataatagtctctgatggtagtttgtatttctgtgggatcagtggtgatatcccttttatcattttttattgtgtctattagatttttctctattttcttctttattagtctggctagcagtgtatctattttgttaatcttttcaaaaaaccagctcctggattcattgatttttgaagggtttttcatgtttctatctccttcagttctgcttttatcttgttatttctagtcttctgatttttttttttttttgatagagtttcgctctgttgcccaggctgcagtgcagtggtgtgatcttggctcgctgcaacttccgcctcccaggttcaagggattcttgtgcctcagcctcccgagtagctggaattacaggtacatgccaccatgcctggctaatttttgtattttttggtagagacagggtttcaccgtgttggccgggctggtcttgaactgttggcctcaagtgatctgcccacctcgacctcccaaagtgctaggattacaggagacatccttttgtttttaaaggagccaaagaagagtttgaatatatgggaatagtagtaatcaattttataaactctggctttaataagttttccacaacatgtcatttgtacatggtgatagaacttgatatacaaactcatttttcttactttataatggtaaaatgaatatttttattatttattatttacacaaaatattttaaaagatctgtgttaattggttgagatagtccccagatctctgattcagttacaccatcgagtgctaccaatatcacttgagttcttaaagcacttctacagaatctgagggctaccggacacagattttaaaacacaacatggaacaattaagtgctttataagtattatcaagaaagttggacaataatttgaatctttttttttctttattcaaaggctagaataaaggatacataaaacaatctgattatccatcaaataggggattaggtaccctttatgcaagaggcttatcttctctgagaattgaaaacaaactcagagaaatatatcatctgttgttgcattataggtagaattatggcatcactttcttaaaattccaaatttttactgttgaacttttaatatacttccaaaggacttagtggaacaggaaatatggaatattaacctgcacctgttttatctttctctttaataatagggaatggtgagtgatcttttgaaaaacctaaggttatcatgcatatttggcaacttgcatacgtcaaatcttgtaaatgatccagtggcaacaatatatgcctatctgtaggcaaggttctcagtttcttcagaatatagggcagcaaagaaatagctttgctcagttctcttattcctgttacttttgcttttctccagccctttattccatgtaggggtagggaatcttaatgagatgggacaggggctaacttcaggctgtaatttctaggtaattagtttaagaggttgaggcaggagaagaatatgccttttagtttgctaaagggtctgattccttaccctatacatgctttaccttctggcctactcagttctctggaatcttactgttagttaatatcagtttgctggtagtgatttttctgtcttttttgtagatgcttttgaagtttactcattttctagtaaactatctagagtgacatttattaaatataggcattatgtagcctttcatacatgattcatatataatggttaccaaataaatgttaaataattttctaacattatttagtttaaaaacctgatttattacattgtattcgttactgtgtctataactaaacatagacatggcttttatactgaaatgaaaatctgtaaaattctcagaaaaatagaagcctgccatctttatatagggtttaaagttataataataatttctattgagcatcattaatgcccagacactgtagctgggactttccattcattgctcaatttagtcctcacaaaaccttacaagttatttattgctagtatctttttatagttgagaaaactgaacctcagggaaattaggtaaattgcccatgcagagccaggaattctctgacaccaaactgatgctctttctactgtaaaatcctatactaaccaaactaatatgtttactaaaaatctatacattaagccatcattggattgggctttaggaaaggatatttgagataacaacataaaattaaaattatgtacttcagggaagaatatagtacacatcttgaacatgggtataaacgtttgcatttcagggagatgatagtattggcaaatgccagttttcttcagatctactttcatcagactctgactataaaatgaaatagtgattgtcatattgtataatgaatatgaatttattttgaaagtcacttatttattgaacttatcaataaacattccaaaaatgaagaatattatttcaggggaaatagaatcattgagcctaccattgttctgtttcccttgtctactgcctttaaatgataaaatggagttttgaagacaggtagtaacaatcctctaaaaaataattaaggctgttgaatgttaagtaggacgtttataaagagctataaagtggaaaaagtcttacatctcggctgcacaggatttaattatgcaaaatgctgtgaattcaaggagaatgagagatgagttttcacataatattgcaagagaagtacattggaaaaagaaaggagtaatgagaatccatacaagctggggtccagaccccagacaaaggtatacaatatgtcaatcaattaacatttttctaataatagtggtgatctaaattttaggccatatgtggactttcttctttatacatatattttcatgacacctttgtcaggttggtactatttcattttgcagatggagaaacctagtctcataataactaaatgtcttattaaagtcaaattggcaatttgggtagaaaagaaacgggaatttatttactttgagtcttctagtcattggataatgtttcctataatattattttattgccatataactcagttttctttgtgatcttgaaatagcttaacagtagttaatgaagtattacagatatataggatgacaaaatttaatgagagatattatatgagtggagtgagatagatatttaactggatattgagaaaatatggttagaggtgtcacctacttgaagattataattgaacgccaccagaggaaattgttagcacggcacaaaccactattagagtgcacagagaaaggtttagatataatctctatttcaataacttattttataatatagaaactgtaatatattttagttgagctataatttctattcaataattacaaataaggtagcttgctatctgacttagtttttttttttttttttcgagatggagtctcactctgtcacccaggctagaggacagtggtgggatcccagctcactgcaacctctgcctcccagattcaagtgatcctcgtgtctcagtctcatgagtagctgggggtacaggtgtgtgccaccacgcccagctaatgtttgtatttttgaatttttagtagagacagggtttcgccgtgttggccaggctggtctcaaattcctggcctcaagtgatctgcccaccttagcctcccaaagcgctgagattacaggcctgagccatcaagcccagccctgacttagattttatttttttaaacacttctacaaaacttttcctccaatttgagactatgaaggtaccagaatgtatctaagtctgagattccactataagaaaggaggaacctctaggacatagaatgtcagaaggatagtaataaggttagaagaaagatataaaaagacataggataaaggaaataataatgaaatcttagacttgatttattgccatatacttttataatagtttgtagagaactactggtcctatcttccagtgactactgatgtggaaatggtacaccagtaatgaaggaggttattttattgatcggatagcctctttaacccctaagaaagtgagctttaaaaacttcatgtggtctgacatatctgtacaattgatgaaaggaacgccaagtagcaattgccaaataacaattccaggacagccaacctctgctaatgatgtaactggcaggagtctctaagaccattttcttttcactggtccccagtctaattgctgtaaattaaaaactaagggaagatagagacgatagtagttgaaactcagggtgaattagcagctgggaaaagttgtgctgccctctactcctaacctttggtctagttacaggcaaggaggtgttctctgttgaggctttggataaagtatttattggtggctagaccaccgatcttatcaaatagggtgtttgatatcagttgttatctttaaaaaatgatgtgccctgtggttggctcctcaaagttgtactaatccctggaagctgtgaatattaccttacatgataaaaagaattttgctgatgtgattaaggttaaggactttaatatgaaagattatctcagattttccatgttgacccaatatgatcaaaaggggccttttaagaccaaactaggagggacagagtcagtagcaggagatgtgacaatggaagcaagaggttggagtgatgcaaggaaggggccattagccaaggaatgcagagaaggactctacaaactgaaaaatgtaagggaacagattctccccgaaaggaaccatccttgttgacaccttgagtttagacttgagtttagatttctgccctccagcactgtaagagaaaaagtttgtggtattttaagccactaagtttgtggtaatttatttcatcagcaataggaaaacaacacataccttaagccccattttccctccacagcatctagcacatgactgaacacatggtagacagtcaacatttattcattgaagatcttaccagaaaagctagtaaaagattaattcgaagtgactcagtatttatatagagaatatctatataatcaatggacagttgttggaaaggatttggaaatgctttaaaatttctataaaatgcttgaatttgtcttgagcagattaaggaccaaggtagctaaattgtatgcaaagcactataggtctccatatttagaaagtgtgggtagttagtagtccttagaaaatttgacattgtatgttatttttcagctctagcagaaatatcttgagtgcagtaggccatccacattactgtttgtatcactggaattcaaatctaattataataagtaggaagaagatagtttggtgtgtttgggggtgtttggttacattcaccttcatcaaccgtgtcagtgaacaaatgtaattaatttaattgtttaagactccatcatattgataggttcaaataatggacaagagcatatgcagataggcatgtttaaaataatagcctacatggtgctataatagcctcagaatgagttatataaagtagcgtgtttgttagtttaagttgaaggccctgaagtagggtgcatttgttactaagtgagtagctaaaccaaaataatataaataataccttttcttaggctatggtacaaaaattgactgtaaaaatattatataagttgtagctgattagtaataaacaagatattaaaatagaaaatactcattttaatgtctttctggtattgaaacatcttaaaaatgaaatttatcatcttgtcattaccagatggccactctttttccttttttgagcttgttaatagtgtcatgtaatcttataataattttttttacaacttcacttcctggctgggcacggtggctcaagtctgtaatcccagcactttgggaggctgaggtgggcagatcacttgaggtcaggagtttgggaccagcctggccaacatggtgaaaccccgtctctactaaaaatacaaaaattagccaggcgtggtggcatgtgcctgtaatcccagctacttgggaggttgaggcatgaaaatcacttgaacctgggaggtagaggctgcactgagccaagatcatgccactgcactccagcctgggcgatagagtgagactccatctaaaaaaaaaaaaaagtaaaataaaaacttcatttcttttgtcttttatatgtaaactgtaatactaaatcctgctaattcttacttgttaatgtctctgagactgtcccctttgtactctcatccaattctctacaattttgttcttttcgtggttacagaaacttctatactaattcctcctgcttttcatctgtcgcatattcctatttcactactcatttctctctatcagggatgcttttcagcagacgttttaatctacttcaattttcctgaatcaaggtgtgttctttcttggaacgccttcttcattcatttccactaatgcatatctcttactccttcaacatgaacagacacttttcaaaagaagacaaacacgtggccaacaagcatatgaaaaaatgctcaatgttacttatcattagagaaatgcaaatcaaaatctcaatgagaccatctcatatcagtcaaaattgctattattaaaaagtaaaaggccaggcgcggtggctcacgcctgtaatcccagcactttgggaggccaaggtgggtggatcacctgaggtcgggagttcaagaccagcctgaccaacatggagaaaccccatctctactaaaaatacaaaattagctgggcgtggtggctcatgcctgtaatcccagctactcgggaagctgaagcaggagaatcacttgaacccgggaggtggagtttgtggtgagctgagattgcaccattgcactccagcctgggcaacaagggcaaaacttcatctcaaaaataaataaataaataaataaaataaaaagcagatgctagcaaggttgtggagaaaagagaacactaatacactgttcatgggaatgtaaattagttcagccattgtggaaagcagtttggtgatttctcaaataacttaaaacagaactgccatttgacccagcaatcccattcttgggtatatactcaaagcaatataaatcattctaccctaaagacacatgcacgtgtatgttcattccagcaccattcataatagcaaagatacagaatcaacttcaatgccaatcaacggtggactggataaagaaaatgtggtatatatacaccatggaatactacactgccattaaaatgaacaagaccatgtcctttgcagcaacatgatgaagctggaggccattaatctattagaactaacacaaggacagaaaaccaaatactgcatgttctcacttataagtgggagctaagcctcaagtatatatagacacaaagaagggaacaacagacattggggcccagtgtagggtagcgggtgggaggagagtgaggactgaaaaactgcctataaggtactatacttattatgtgggtgacaaaatctgtacaccaaacccctgtgacctgcaatttacctatataacaaatgtgcatgtgtacccctgaacctaaaataaaagttaagaagaaaactaattcaaaactttttctagccgcggtggctcccaggtgtaagcctagcactttgggaggctgagacgggcggatcacttgaggtcaggagtttgagaccagtctggccaacgtaatgaaaccctgtctctactaaaaatacaaaaattagccgaacgtggtagcgggaacctgtaatcccagccacttgggaagctgaggcaggataattgcttgaacccaagaggcggaggtttcagtgagccgagattgcgccactgcactccagattgggtgacagagcgagactccatctcaaaaaacaaacaaacaaaccttaaaaaatctttactgattagtcttattcaactttagttcctctttattcttattgtgtttccctgcatctactgattctctgacttgtgcttggtaggtgaggcaatgttggttcatatgcactctgtcactcttgttaggtgcaggccttatctctgtcgatgtcccagatgtgtatactatctgttcggtgttcttcaatgcagattcagctttatacacaggcaagtttcacagaacaaaggtcaaaagccatagctaaagaaaatggcattttgtgcttgtgactgctgttttctaggttattacctccttgaaatcagtaacaagccttgtttgttttgattcttccacaaaacagttccttacaaataacaggtgctcaatcagtattgagcttgactgaaacattataattaattttctattaaatattaaatcatgcaaatagctgcttttaactttaactattcaatctatttgcaattagcatgactttagtgtatgtgtatgtgtatgtgtgtagcctaacatagggccagctacatagtgaatgtttagttgatggcaattaacaacagtaatatttgaaaaagatccagtcttcctttacaaatatgcaatagagatttggggcattgttgctataaattgttaacttggttaactctatgtaaccgtctaaaataaatttaacaagtagtgttcactaatgtatttaggattagaacaggaatagtcaattgccagtaagtaaatgatctactcctgtttcctatcttcaaggaatactgtggggtaatcaaagtgtgcacacatgaaataacaaaataacataattacttgttccacaacttgtgacacaaaatcttaagttctgtagaagtttagaaaaggaagggatgtcatcgttttcaggttttttgtttaaagtaagtctgctttttatttattttggaatgatttggagaatcacagcctccttatccttacacatttaaactgtatacactatttgcaagaattttgcttttctttttttatgcagtatagtgccctctggtgaatgttcattcctgcataagaattctatttcacttattaattttgtaaattaattattgtatgaaacataactagaatataaattctatttacttattagtttctagaaaatagtgacatgttgaattagagaaagataatgttctagtttataattaaaaattttaattgattgtaacttaagcccatgcagttttcttttagtaggtgtaaggaaaattttcctgccttctttctgcagttactttcctttgtgagaagtagattatctctgtgtttattaatagtgttgtcagttgctatttttgcatttcttaaagataagcaggttttacttaaactgatgcctcaatgaaatacaacaaagtcaagggcattattctgaaggggaaaccatttgaactgtaggctcaaatatcccaggtcaaactgggctgcattaatttttccccttatttaaatcatgaattatctcttaaccctttattaacaacatgcttacttaatgagatagcatctagtttttctggacataactgaaagctagtgtttaaaatggtttgtaacagtatagtgagtcagggcaaatagctgttttagttagatatattttaagattttgaatacagactatgacttcagtccaattcttgacttttctcaagaagtaaactaaacttcaccaaaacaaaaaggtgagtatcttaaaagaacagtaattgcccttaccaatttttaagttctaggtactaagaactctttcagatagtaacaagacaactaactgcaggtttaatctgctatttgtgaatgactctattgtttcttttagagacctgattatggcacttataaagacattaacatatatattatatatatttatatttatttatttatttttaagtggacctaagttgaagggaatatatattgaattctgctaattattcacgtcaactctgctgttcacatcatgttgatatgatcttcctttcccactagtaacctctctatatatatcactcaaaactctcttctgaactgacagattgatggaaatatttttaattccttgtgacaaagaaagaaaccaggctagccaagttctgctaatttgactattgaagactaattaacattgacatgtttgttgcaaaaatgtcaaagccatggggaacttggtcaaaaataatgctcataagtttggagaatttagtatatcttggataaaattcttcatattcttcatgaagaaacttatatactcactaaaatgtattctcccttcaagatatagctaattagataaatttgaactggatattgggggcaagatggccgactagatgcagccagttgaaacagctgccaccaagggaatgagacaactggcgcactaacagatcttcagaaggagggcactgagaacggacagagggaagacatggaagctgggctgaaggggaaacaacctggaaaccctgcaccaggctactgcacactaggactcatttctggcctccagcaaatccagaggaatgaatgaattgaactgacaaggagcaacctgctcttgccatggacctctggaatcctggcagaaggagacagaccccttgaccaccatggacacttgagttggcagggagagctgcttagagaagtggtaggggcagcatgccagctgatgtggagcccagagggtttggcgcaggagtgtctgtaacaaagcatggtcagggatggccacccgctaagcttgacttgctcccacaggagacattagccttagaggaactcttggacttgaattctgcaagatagtcttgcctgtcagaggggaccaggccgacttgagcatcccttggtctgctggcctctcccggggccccatcctggccgtgcctgctagtagggcagactttggttctctgggggcccacattataccttctgtgttgcagatcatgcctgactggtggagagctccagcactggggcctccatggccatgcaccagtcctcctgctccttccccacactgcagcttcccctgggcccacagcaagcctgcacatctttttgccagcatgtgcgtgtacaggcgggttttggtttccttgcctgccagccagaatagtgtgtgcatgcactctgcccttccactgccacagcaggagtggagtccacctccatttccctcaccaactgccattgcaaatggagccttgatgggcacagagccagcctgccctgcctctgccagtgcattgcccttgtgccaacactggtttgggagagcaactaggcacagagaacaacataccctcccccaccctgagttactctgcctgtggcacacagagaaagcacacagacctatgcccaccagcacccagtccctgttccaacaccactaccagcgtgacctcacacacagttgccagcaggggctgcctgcacccccaccagtcacattgcctctgccattgtagtgaatgtctgcacggagcaggcatcctggtacccactagcaccctgccacagccaatgagcatgcactctgccatgctactgctgctgctggcatgtgcaaataaggacaagtccctttgtcacaacactataaaatgctttggccagcaccaccctttggagtgcagtgagcagtggtccaggagcacatcaccacccccacaccccagtgcagtggattcctaacctcaaggagccaaagtcagggcccaatacaagtccccctgcattagagcacccagtccaggagttgggaactgggtgttggctccctaaaatcttccagaaatgaagccaataagctgaatctatttataccataatcaaaccctcaaggcaatcaaataggataaaagaaaaaacccatccaaagggcagcaacttcaaagactgaaggaacataagcccacaaagatgagaaagaacctttgctagaaccctgacaactcaaaatgccagagtgccttctttcctccaaatgaccataccacttctccagtaagggttctgaactgggctgagatggctgaaatgacataaacagaattaagaatatggataggaattaagatcattgagatgcaagagtacattgacacccaatccaaggaagttaagagtcacaataaaatgatgcaggagctgacagacaaaataggcagtatagaaaagaacattaactgatagagctgaaaaacacactacaagaatttattaatgcaaccttaagtattaaaagcagaatagaccaagcgcaggaaagaatctcagagctataagattggctctctaaaataagacaggcagacaagaatacagaaataagaatgaaaaggaacaagcaggctggatgcagtggctcacacctgtaatcccagcactttgggaggctgaagcgggtggatcatgaggtcaggagattgaatccatcctggctaacacagtgaaaccccatctctagtaaaaatacaaagaaattagccaggcatggtggtgggtgcctgtagtcccagctacttgggaggctgacgcaggagaatggcgtgaacccaggaggtggagcttgcagtgagccgagatcacaccactgcactccagcctgggtgacaaagcgagactccatctcaaaaaaaaaaaaaaaaaaaaaaaaaaagaaaaggaacaaacaaaatctcctagaaatatggaattatgtaaagaaactaaatctatgactcgttggtgtccctgaaagagatggggagagtacaaccaacttctaaaacatatttcaggatatcattcacgagaagttaaccaacctagctagagagacagacattcaaattcaggaaatgcagagaacccaagtaagatacttcaaaagaagaccatcccgaagacacataatcatcagattctccaaggtcgaaatgaaagaaaaaatgttaaaggcaactagagagaaaggccaggtcacctacaaagggaagcctgtcaaactaacagcagacctctcagctgaaaaccgacaaaccagaagagattggttgccaatattcaacattcttaaataaaagaaattccaacccagaatttcatatctagcaaaactaagcttcataagcagaggagaaataagatccttttcagacaaacaaatgatgagggaaattcgataccagccaactgccttacaaaacctcctgaaggaagtactaaatatagaaaagaaagactgttaccagcccttggaaaaacacactggagtacacagaccagtgacactataaagcaaccacataaacaagtctgcataataatcagtaatatcataatgacaggatcaaatccacacatatgaataccaaccttgaatgtaaacaggataaatatctcaattaaaaggtgatgaatggcaagttggataaagaatgaagatccaatggtatgctgtcttcaagaaacccatcttgcatgcaatgacacctcttaggttcaaaataaagggatggagaaaaatctaccaagcaaatagaaaacagaaaaaaaaagcaggggttctaatcctaatttcagacaaaacagactttaaatgaaaagagatcaaaaaagacaaaaaaaagagagcattacataatggtgaagggttcaattccacaagaagacctaagtatcctaaatatatatgcagtcaacacaggagcacccagattcataaagcaagttcttagagaccgtcaaagagactcccatggaataatagtgagagactttaacaccccactgacaatatcagacagatcatcaagacagaaaattaacaaagatattcaggacctgaactcagctctgaatcaagtggatctggtagatttctacagaactcaccacccaaagacaacagaatatacattcttctcattgctacatggtacatactctaaaattgatcacgtgattagacacaaaacacttctcaacaaaggccaaaagaactgaaatcacaacaaacaatctctcagaccacagcacaatcaaattagaaatcaagactaagaaattcactcaaaaccagacagttacatggaaattgaataacctgctcctgagttacttctgggtaaataatgaaattaaggcagaaaccaagatgttctttgaaactaatgaaagcaaagatacaacataccagaatctctggggcacagcttaggcagtgttaagaaggacatttatagcgataaacacccacatcaaaaagttagaaagatctcaatgtaacaacctaacatagcaactaaaagaactagagaaccaagagaaaaccaagcccagaaaaccaaatgtagcagaagacaagtaataacccaaatcagagctgaacagaaggagattgggacagttgaaaccattcaaaagatcaacatctccaggtgttagtttttcttttaaattaataaaacagatagactgctagctagactaataaagaaaaaaagagagaagatccataattaaaaacaaaaaaggggatattaccactgaccacacagaaatacaaatagccatcacataatattatgaatacctctatgcacataaaccagaaaatctagaagaaatggataaatttctggaaaaatacactctctcaagactgaaccaggaagatattgaatcctcaaatagaccaataatgagctctgaaattgaggcagtaataaataacctaccagccaataaaagcccaggatcagacagaatcacagctgaattctatcagatgtacaaagaagagctggtaccacttctacagacatgattccaaaaagttgaggaggagggactcctccttaactcattctgtgattccagcatcatcctgatatcaaaacatggcagagacacaacaaaaaaagaaaacttcagtccaatatccttgatgaacattgatgcaaaaattctcgagaaaatactggcaaactgaatccagcagcacatcaaaaagcttacccaccatgatcaagtatgctttatgcctgggatgcaaagttagttcaatatacacaaatcaataaatgtgattcatcatataaacagaagtaaagaaaaaaaccacatgattatttcaatagaagcagaaaaggcttttgataaatttcggcagcacttcatgttacaaactctcaaaaaactaggtattgaaggaatatacctcaaaataataggagccatctctgagaaacccacagcctacatcacattgaatgggcaaaagctggaagcattccccttgaaaagtggcacaagacaaggatgcctctctcaccactcctattcaacatagtattggaagtactggccagagcaatcaggcaagagaaagaaataaagggcatccaaataggaagagaggaagccaagctatccctgtttgcagacacatgatcttatatctagaaaaccccatagtctcagcccaaaagctctttaaactgataaacaacttgagcaaagtctcagaatacaaagtcaatgtagaaacattactagcattcctacagaacaacagtcaagctgagagccaaatcaggaattcaatccccttcacaattgccagaaaatgaataaaatacctaggcggtagctattgtaaacaatagtaaataggagtaaatacagctaatcagaaaggtgaaagatctctacaaggagaactacaaacaactgcttaatgaaatcagtgatgacacaaacaaatggaaaaacatttcgtgctcatggataggaagaattaatatcattacaatggccatactgctcaaagcaatgtatagattcagtgctatttctcttaaactaccaatgacatttttcacaaaactagaaaaaaactattttaaaattcatatgcaaccaaaaatagcccaaataagtaaggcaatcctaagcaagtgaacaaagctggaagcatcatggtacttgacttcagactatgctacacggcaacagtaaccaaaacagcatggtactggtataagaacagacacatggaacaatggaacaggataaagagcccagaattatggctgcacacctacaatgatctgatccttgacaaagctgacatagacaaccaatagggaaaggactccctattcaataaatgatgctggaataactggctagaagactgaagctagaccccttccttacaccatatactaaaatcaactcaagatggattaaagacttaaatgtaaaacccaaaactataaaaaccctggaagaaaacctagtcaataccattctagacataggatcaggcaaagattttatgccaaagatgccaaaagcaattgcaacagaagcaaaaattcacaaatagaacctaattaagttaaagagcacaacaaaaaaactatcaacagagtaaacagagaacatacagaatgggagaaaatttttgcaaacaatgtgtctgacaattgtctaatacacagggtctacaaggaactttacaagaaatttaaaagataaaagaaaacaaccccattgaaaagtgggtaaaggacatgaacttttccaaaaaaaaaaaaaaaaagacatatatgaggccaacaagcatatgaaaaaaagctcaaaatcagtgatcattagagaaatgcaaatcaaagccaaaatgagataccatctcatacctcttagaatggctattatgaaaaagtcaaaaaaataacatgctggcaaggttgcagagaaagagaaatggttatacattgtttgtgggagtgcaaattaggtcaaccattgtggaaagtagtgtggtgattcctcaaagacctaaaaacagaaataccctttgacccagcaattccattacttggtatatacccaaaggtatacaaatcattctgtaataaagacccatgcatgcatctgttcattgcagtgcttttcgcagtagaaaagacagggcatcaacctaaatgcccatcaatgatttgattggataaagaagatgtggtaaataaatatcatggaatactatgcagtcatagaaaagaatgagattatgtcctttccacgaacatggctggagctggaggccattattcttagcaaagtaacacgggaagagaaaactaaataccgcatgttctcacttataagggggagctaaatgataagagcttaggaacacagagaaggaaacaacagacaccagggtcttcttgaggggggtgggtgggaggagggagaggatcaggaaaaataactaatgggtactaggattaatacctgggtgattaaataatctgtacagcacacccccatgacacaagtttacctatatgacaatcatgcacatgtacccctgaacttaaacattaaaaaagaaaaaagtgataaatgtcattttatgcatttagttaaaatcaattttctcagttgtggttgttgttcattgtaaaatacctaatctgtttattgccatctcttaagctactttcaaacagagtagccatcagatatttaactgctgttcatatttaatattaaatatttaacaaaaaaagtttatggaatgaaaatgaaaaaatatagaccagtaagtcagatataaaacttattcagtagaattcagctttactagattaatgtatattttatttgggtaggctaagagtaattctaccattatctctattaaattcagtctaaatttatacaacttggcaagtgcttgctatgattttaccttcttcagactagaagtatacttccttctagtaagagtcaagtgatgaaggttctagtttgtccctctccttttaacttcctgtgtgacattaaggcaagtcacttatcctttctcagccctatttatatataaaaggggaattataaccgccttacttgcttccctaagtagttggaaaaattgagtaaaaaacgtgaaaatttgtttgcaaagtaagaatatatatttttatttgttttattcctgccttcactagattataagctactttaaggcagaaaccacattttattgtcttatcctaattttcatttattaagtactggtaacatactaggctgtgttctagctacttgaaacaaaaagattaataatggcgtctattctggaagagcatatactttattatatgggaggatggaggaggggattaagtgggaatggcaggcaagcattcaaccaattataatactatagacctatgtaacagaggcatatacaaatacaagaaagtgcgattgaaacagagatgggaaagttattgattctggcttgtgggaatcatattgtttctcagaggagatggctttaaaagctgttcctgaagcataggtaggatattttttcaggcaaagttggaaaggaaggggattctaagcagagagaagaaccaggagaaagtacagatgtgtaaaagtactttgcattttctggaaagactgagtaatttggtattattgaggtgaagggtaaatgcctggggaactagcttgagaagatcccagagaagttggctacgcttaagtttttagaagcttggagaaaatattctcagaagaaagattggttagaggaaaaggagaccagaggctgggggattatctagaaggctgatgtagttctctgtaatgctcaaagagattttgaggatttggcagtggcaatgggaatgaagaagggatttgtttgagaactatcgctgaaataacattgacaagatttggtgattgaaagaataatgtaagagagggaaaatgaacattttcagctcttgtgactcagaaccacacacattgccttgtacataggaagaagctattaaattgttgtctaatcggattgattaaagctctttgctagtagcacatattaataatattatcataaagttaaagctttagtttcttttctaggctgccattccagtaacatttgggagcattaaattcactattaaatgatttttaaggtctctaagggcaagaaaacaattctgtttttcaagtgaaagtataaagaatttatagattggctttcttgttcttgaagacagagaaatatagatatttgaaaacttgctaattgctattatttcaacaaaattgggttgaagtttatattttcagtatacttagtaaaaaggcttactatacagatttatagtaactttaattagaagattgcatttgtaaaaatttttaattaccttagataattctcaaaaaaggcctctgaagttaactgaaaatatattatcatacccaaatggtagctgagaatgctgatgcttaaaaaagtgaaatcacttgtctaagtatgacagctagtaaattccagtgtcaggaattgccttcatcttttttttctcaaattgacttatttattttttacatcgacatataaaattgtatttatcatgtacaacacaatgttttgaagtatgtatacaatgtggataatagctaagatatggaagcaaccgaattgtttatcaacagatgaatagattttaaaaatctggtatatatccacaatggtataaaattcagctataaaaataacattttttgttgtaacagcatgggtgaatctggaggacatgcccccatcttttgatttcaatttttgattgagacccaggaatatgattttctaacaggctcctcagattactcttcaacagatagcacttgaggataaatacatttgtaaactaatctggggagtaaaagacaagaatagagtttgggaggagaattatctaaaacagaagtaggtgtctacgggattgtaatgggattgtagaggactgtagggtagagtctggcaaacacggagaaggagttaaacttctaagcccttaacccaattcctgagttcagaaacatggagcagtgcttgtggtggtggtactgctgtcttttttgttattatttgtgtatttaagccaacatcaaattaagcagaagtggagcaaatttaagtataaaaagtatctgtcctcccttacttggacctaattgtgaaaatgtgttcataacttccctggtgaaagtcagaatgcatatcttgcagcaaaatataagctccaagagggcaagatctttgcctgctttcttcattgttctctcctcagaacctagaaccatgtctgctacagactatgtactataaaaatatttatggaatcaaatttccggtggaaagacatgttttaaatgtatcctttgttcttgttgttaagaaatgatactgtttctgtaattgaagtctcaaaaggctaagatatcagaacataacataaaagcaattgttgtttggttgcattgctgtttattgaacttccgtaagtactccccaagactggactgagcactgtttggaaaggcatgatcgcagtggctgttgggtctttttgaaatagaactattactctaggtacattatacactaaatagacctttgtgagctggcctagggatattacatttagaatgagttgcgtcagttgacttgcaatttaggaaaagtggtaaatcgatgttcaggggatgactatgaaattatctgaaagatgtttgcaccttggtaaggtttaatttttactattttttgataatactaattatgatccttgtttatttattccaaagccttttatccatgatctgatttatattggcactcacagcagcagctcaatcggatgggagatattattcctattttatagatgatatttgagacttgagctaaagcaaggcacatcaaattgtttcaaaatttggtctagttttgttggttatagttttgtctccctgtggatgagataaagtcacagggctgggttcacatcatttaattactttgaaaatttaaagtaacaaatataaattcagaaacacttttcaaattgtagttaaagcaataagtgatgagtacagttagaataatttgctgcttagcacaagtccaacaatataataaaagataataattaaaaataattaaaagtgaagaatgtaatttccaaacatgttcacatcttatttcactgaattcttgaaataatgtctattttatgggtaaggaaactgagtttcacaggaaacaaatgacttacccagggctatataactggaaagagtcgttccacttctataaagtatatttctccaagtgtgcccaatagaaaatgagttttgaagattttaaaagatttctcccatcccctccagaataagaagctttattttcaaataagcctgagaaacactgggttgagttctttccttccttcctccctccctccctcctttccttccttccttccctccctcctccctccctccctccctccctccctccctccctccttccctccttccctccttccctccttccttccttccttccttccttccttccttccttccttccttccttccttccttctttttctttcttttctttcttcttctttttttaagacaaggtcttgctgtcacccaggctggagtgcagtggcatgatcatagctcactacaacctcaacctcctgggctcaacccatcctccctcctcagcctccctagtagctgggactacatgcatgcaccaccatgcctggctattttttcttttgtaaattttagtagagatgaggttttgctgtgttgcccaagttgacctcgaattcctgacctcaagtgatccttccacctgagcctcccaaagtgctgagatgacaagcatgagccacccgtcccagcctaagatgtggttttctatgttcaaatgtttgtaactgagttataacctattacctactgcctactccaaatcaatagctttcatgttttacaaagtactttgatacatattctctcactgacttttcataaaacttgagagttaagtagagcagacttttatctcattttatagggaagggaaatgacttacttggaggtctaccactaataaatgattagaagagctagtgcaatctgcattatatgtgtgaagaaccaaaccctgatcagtcccttgctaggaagttgtccctgatgaactacactcatgttatcattctgttcattcagtattacatatgaatttgcactctttggtatatacattcagcctgtttttaggtcattttcactggggcatagtccaaaaggggaaaaaaaaaaagaaactaggtttacttgttttacaaatcctctcctagttagcgttctgttggcacatggtgaagaatgcgcttccctgagaatcttttgcacttgatgatggttgtgtctgagtctgtttagtaccttgtgcccttgcattgcctgtctaaatgaacactgttgataaagtatgtactgcatttgtaaaatgtacaatgatttgtacacttatctgctgatagaataaaatacaaatgtattcatttgacttatgaggaaggcgtcatgatacaatagaaagataccagaagccagactagagtcagaagacagtagttcaagtcatggctcctgaatttacaaatatgtagtcatggcaaagtcatttagccttgctaaatctctttcctcatctgtaaatgggaaacataatagcctgtttgcttcgttgggtgtaaactgtcttattttcttcacagttttactatctggaagcccatctttggatcctaccccaccatagttttcaaacctagcgtgttgcccacacatgaaatcgatgtcagtaacccgaagaggctaatgcactttcataacatgggatttttgttctcatatttttggagggaaagtaagttgcataattgggtaagcaccttaaatcttttttgtaatacatttttaaattgataatgtcatttcttaacatcataaagcagtgattttcaaacttaggagaacattatagactagagggagcttgttaaatagtatacattttcaagtttaacccaaagtttccatggttttgggtgggagagtcaccattaaaaaccatttcaatcatgaagaatcccatgaacaaagatgtaaaataaaatgacttatgaagattagtcaggcacagatacaagttcccagttctgagtccattattttgtgtttcaggccactcttccgtctctgttgccaagaaggggagatatagattgggtgatgttcttgtatgtcttagaacacaaatccattgtaatctggtttcatgaactctataatcagtctctgtgcaaatctatgcatcatattgctttggcactggtgcgaggatcattttagtggatgtattgcatccacagaattgactgggtgtatgctaaaatatatgtgcaccaaaaatagatttttagcctcatttatcttggtgtgattattacacattgtgtgcctgtatcaaaatatgttgtgtaccccataaatataaacaatctagtagaaaataaaaaataaaataaaaataaaaataaaaaacagatttttaggattttgttactgattatgattctgacagaagacagtaatgaatctagaaactgtcaacaacaaacttctgtattttaaaataaaactatttttgtggatccataaacagactgagaaagagtataatttggtgttgctaatgtgaaaagacaggtaatgggtgttggcgctaaagttttgacttaaaacatttataattgagaattatgcttgtaatgatctgcttacacatcctaaaaaggaagaaaaatacttattcatgttacaagataagtagctttgaggtaaaaatttggactgaaccattttctatactataatacttatttcagctttattttattctactttagtttttaatatttttcatttccattacttcatagaggccctgtaacagtgtatttgctttaggttaaagaaaataaaagcagaaacacaacccatcccagcaggttaagcatttcagtctgccctctatagtactttttaagtgtggtagtcatattttgttactcaatattaatataattacaatcagaaaatactacagtttctaatataaggtatgaatatatcataaatgtttcctgatcacaaataataataatttttttttttgaaatttaactcctgggcagacagcatgttttagaggactttgaaatcttactaggaaaaacataaaaatgtagcttttattatcatcacatggccattataactgtaaaattggttgtgttaagaattgaagatcagggttcatggattacattgacaattttgtcataaacttcctatttaactgtgaacatccaacttcacaccttttgttcttgaatttaccttctgtaaaatatggtaataatatttaactatgttatacaagatgttatgaagcttaactttcctttttcaagattcccaaatataaaggaccataaaaaatattagcactattactctgactgccatttttgtgaccagttttagcacagtatgtataaataaattggtgagttatagtgtccttttttctactatgtagttcaagaattttgcgtgtatctttcccttttatttctcatggactcaaaggaactcacggacttgaaggaaccatcttgcacaccccttgacttaagttgaaaaattatttattttattaattgagcaagcatttattggacacctacattccagcaattgcgttttgtcctggaagttcaaaaatggtattgttcctgttcctgcttttagggggctcaaaagtataaacctaaagtttcttcatctgagtccttctactattgctttaggtacagtgcaggaacgcagaatgctgatagggccaaacaaagcatttcagttgatcatgtctactgttcatgattatgtctgctatttcataggcatgaagctttaaggcactcagtcttagtttccatcattcatacattatctagctgtgagaccttgggcacatcagctatgctcctttgcatcacagttttctcacctgtgatctctaagacctcattagttctcagtttctgtggtttctatcttccacctatggatgtggcacttgtttataaaggcaaagaagtttgtttcttttgattagcctcattagacaatcaagactggcaaagagtgtctgggatgccaggtctcctatcaacccttgagtagataacatcttccatggtacgttaaagggaaatgatgagcttggtgattctatctaaccctccgtaaacacaaacaaactcttaaaccaagtttgttgtctgcttggattgcatttccttaaattagagcaatgaatcaaactgtattttactttgagattattgttatgtgtagtgttaagtgaagccagaaatgacactttttatttttcaaacaaggggctttatgtgatttactgtacctttgtagtaggctgatttatcttgctcaggatatcctcattgtttgtattcctcagagtccttcgaaaactcaatgcataatttccatcccagtgcagataacacaggctccccaaaagtttcaacttagaatctgtgtttttcttttcctccttcacatgagtgagtggaaggaggcttagagggaggagctggcctcctaccacttgtgtatcatggtccagcaactcaatgctttaggccattatttcaaaatccaatatattcaaactttggcctctgagagcaataatatcagtacacaagaacaacagagtgataaatatagaaatttcatcaaggaaaagactatatcctgtcattctgaatcaatgtttagaagatgatctcagcattcaccacctactatgggctttagctttgtgcttatgaagaaaaaaaatcattagaaaagaaggtgactgtgcttctttcaaatattatgatggcgtaacgaaataagtttaatatatgccaagagtgagctccactaacactgtgatgataatttgatgtgagtcccttttgagccttgcataattgctgccatgataggtagtgcagtgcagtgaagaatggtttgtgcatagccacccaaaatttggctgactggcataacacaactgttaaattttctagttttatttttcttcacagtattggttcatttgttaccattaaaaatgcccattttgttcaaaagcatgattactatctctatttttttgaattacatattatatcatgatcacaaaagcgattttgtattaaaatgcatgtactttttcatttaggatgtgtataatttttctgagtgtgattatatccttttaagaatactaatttaaaaagctccctcatttaaccttgtgagagtttaatttttaaaaaaatctcaaaaagcaaaggaatgaattagtagtaactttattgttgttagtctatggactttggttttgcaaacttctgtttaagatttctttgatagtgaattaaaagaaaataaaagaaagacaagaaacactgacatcagctcaaaaggtttttgctgatttttagttaagaaagctctcaatggctactagtctttcacctgcaatccagtgtaataaaccttcactgaagaagtcaaattctaggggaaaaaaagttggaagcccacacttacaccataaaaccttgtttatgacaaccatcagtcttctaagatatgccccacaatgggatttggtaaagccattacaagttgccgtatgagttccatttgcctatagtaaatagaatgtcagacgtgtcagggggaaataaatattgggctggttaaaagggagcagagatggttcaaagcatcattgagaggattgatttatctggcgtgctgtaatgactgcagatgtggatctgttattctagatgagcaatgcatttgatgagctgataacacagggccagagaggcctggttttaattactgatgaggaatttatttgtgaagcactgtgatttactgagggtttgttctgttattgataggtgaccttggggcttttcttttctgatgagccacagaaaaggagcttttaaaagaaataatcaaacagaaactattttatctgtacttagaatacaatgaagtcatttgagatacattgttggggtggaagctacgttcttgttcttgctcacacaaaaagtttgccgctctgattttttgcttataaattactgctgatttctactcttaagtatatttatatatttttccttttaggcaagacttgtttctgtgactagatattggtatctatttgtttgcttctgtcattaatataaactgttgaagcagaattggaggaaacattgggatgtcaagcatagctggctcattaaataatagctaatttgtgtactattcattgggagtcagaagggagattatgactctggtatagttctgttggtgaccagcagtttctcattcttatgaatgatacagaaaatctaaattaaagaaaaggaggtcaaaagaagagcaatcattggtattcatagttttaactccccttcaagttcaggaatttgacaaatgacatattttggatatttgtagtgctatttgtacaccctttaccttggcaaaatatggttgatctggaaatcctaagtatgttcttttaaatttaaatttggtactttgaggctttcatctaaagtataaattcaagtgtgagttccaaagtgtcacttgtctattttattttatttcaactagcagtttacagaagtgattcagacttttgtggaaaacatagtaatttctgtatgtgcactctgttagagttgtttgtaaaaaatgttgaaccagttcattttatagatagtttattgtttaccagctatttaaaaagtcacaaaagaaagacaacatctggacttcaaaagttcctagagaagacctgaattgcattgaatggtatttatatgtataaactactgtggttcatttggggagtcaagaatcgagtcaactgggaggtagtcaactaattatcttttgcaatctttgtatcttactgcatttctttattttgctctaatttttgaagagctaaaaggcaatggcactgcagtttttgtgaggattgcagtgttttctgcaaaattattatacaatccagaatgttgaaaatctttgtgtatataaatagacattagattgctttgtctggatttgtatgcatgtaaaaactaattaaactattttatgtatagtgttattttattaactaatattctgaatgttttgaactgagaaatttttatgaatcatgataaatgtgactactttagaatgaatttatgacctaacaagcactttaaattgtattataacatatacctaatgtatgtgttcatggttcatgcaactatggagttttttgatttatcaagccaggctgattggaatatctttaaaattgaagtttagtagagataaaataataattacagaagaatttgcctgcctttttgtctgtattgtggttttatatttttattggggagacatcgtttttccttcttgcatttttctattgtggaattaccactataaactacatgtaaatttttatattatctcattaactaggagattcacttctcatcttactaattttgaataggttaagttccactaaacgaacatcaagtgtgtattttaagacaatgtgttctaaatgctctgaaactcacgaacgttagttaaaggatcaaatggttaaaattgcagtctattttttactgcaacttttacccaggaggcacaaaagtcagtgccttcctcgaagcatgtgacttacttccgccatagaataaatttcatttatctgactttacatacactctttaaactcttcagtgcagtattctattagcattctattagtctccaaagaaaatagcagtatttaaactttcctaacagtattatattagtatttattagtctccagtgaaaatataaataaacggcataaattccctttactgtgatgagactgaggaattaaaattaaatacttttaaaaagttgacctaggaagggaatgagcataatcaaggggccaaggctagacaaaggaataaaggtagcgtaggccctcgcctatgaattgtgtatgcaatgtgatatttaatgaacgtatcagaatttatttatccaaacaagttatttagatacaaatatttcccaatagtactgcttctgctcataacaattttgagtcgtccgtttttgtaattattttctaattatttggttcatctttctaaatatagtcagtggtggcagtccttgtcctttagggtggattatttttcatcataacatcataaaatttagatattagtgaaaagctggcaaacttaaattatctatttttaagtctcgttttccttgacctttctgcagcctttgaaaagattgacattctttccttccttgccttctgtgacaaaataatattatttcctctttgatttctcttcatttgttgggcccaatttacgcccatgcctaaggaataataaaattctgttcttggctctctgttcttatacttctatattcattgccaggaagagttcatgacttaaattaccacctcgtcagaaatgatccacaaacttcagaaacaatagcttcttttcttccctgtcttaaaattccagctgccttcagtattgtctacttcatgtatcccaaactgaactcagaattcccatctctaaatcagccttcataattgttcatattaatattaactgcttatataataagtatatatattcttaagaattgtgtatagcatctctatgtttccaatttaagaatctcagggttctcattcatactttctgacttttgaccccattttcaatcatttacctaatgtaacccaaactttccttttcaacatttttttccgaattttcctctttttattccccttccttattttctatttcttgtcaactcaaatgtaccacaactataatgctttgatagccttctaagtgtttcagtttcttcttctggtttatctttcacattgcttataggacactcattttctttttaaagttgtatggtatgatgttattctccttaagaatctttagtaaatccttaagagacaatttagttgcccttagtaacaaatttgaacacttgagccaagcattcagccttttcatttgattggttatcttatgtctataaaactttatctgaccttcagagttttaatttgcacatcttcagttgtcacctatgtgactcacaaattaatattttcagtttgatgtgatagaagaaggatgaaaccggtaaatcaagttacttggcttggcttctatccaagtaagtgtgggtgagtcagagatctctacagtgcgtgcagatgacacttaaatattgatagaattaagatactgcttaaacagtgttctatcactatatcaccatttaagagtagctgtctttattttcctagatgaacatagatatcacaggtatagcctatccagacaatttttcggcattagttctagacacccttttattgtctgtgtaagattcaaaataaagaaaatttagcatcttttatagctgtaaacatttgggttcacaatgaaaaacctggtggtggaactgaatgttcttgcatctgtctagctgtttaaagtagaagaaaatacatagtcatttggcacttgtatcatgtacaagataaagggagaaaaacctaatcctattgtatcaaacatggagtatattttattcaagttattagcattctaaaaaaacaaggttgatattaaatgatggaggaagcatttgtgatgtcaggattggtataaggtgcagagggcgagatagtttcctttctctctcccctttgtctgtcttattcttatcttggttacagtccttctcagtatacctgtaatcacattaactttttttttctaattggaggtatttcttttcttccctctctttctctgcacttttttggaaacaagttacccatttggaaggcatgtagttggcaaatttgatgaacatctacagaatacttggacataagcaaaaagtagagttgaatctcaggaatttttgaccatgtaagaattcttagtattttacctagaatggctgaagtttctttggtatcctccttgggaagagtttgctaagtgaaacaaaaatagtaagattgaataggcaatattttaaaaaagctacgcaagagttagttcattttccagtgttttagccatagctcgtcatatataagctatgagtttactatcctatattgcgtaatatacatagacttttataaaattgaggttctttttgaataggtaatgtatgcatgtgttaagaaacattataaaagagcatggcataaaaaggaaacctttcattccattgacccctgtctaccagttacctagtttcctttgattgaggttacatgtatttgaggttgtgccacttcaattctgaacacctgtcttttgctaattaactgactagcctgaaaagagattggttagagtacaagcacaaatgctagggtcttgtcttcctgatagaggtgagggaaattctgctatttgcagtaactagatatgggcaaggatacagaattacccaaatttctacaaaaaagaaggttgacatatgttagatagactcaaaaccttttattacgacaattgtaaatgagctacagctgattattaaagcaatccttagcaactttgttagcggttctcagatatgactacatggatctacattctatacataaaaatctttcactatatccagtgagtatttcctatattcccaaatgagcaaatctatatatacctatcaaattctaaattaaatatattaataactagtccagcaataagatgattttttgtgcatgatggcaaccacctttaaatacattattgatctcaaatttgatacaatatttaattgagtatgtatggacagattgccaaatattaatttgagtatgtatggacagattgccaaatattagcatggagatatgtattttttaaattacactaagttctagggtacatgtgcacaacgtgcaggtttgttacataggtatacatgtgccatgttggtttgctgtacccatcaactcttcatttacattaggtattcctcctaatgctatccctcccccagcccaccacccccaaacaggccccggtgtgtgatgttccccgccctgtgtccatgtgcttctcattgttcagctcccacttatgagtaagaacatgcagtgttaggttttctgtccttgtgatagtttgcttagaatgatggtttccagcttcattcatgtccctgcaaaagacatgaactcgtccttttttatggctgcatagtacagcatggagatatgttttaggaaatatcaatataaataaaagtttcatatttgagagataaatgtttttctggatacctgtttgatagtttgtatttgtgatgagagttactagttgaatgctgaattcaataaattctgccccagagactttttaggagggatttggaaaaaatttatattgttgaataaagagggagacaccacaattacatagcaagagttataaacattgaaaacaaacaggaggctgggcatggtggctcatgcctgtaatcccagcactttgggaagctgaggcaggtggatcactcaaggccaggagtttgagaccagcctggccaacgtagcgaaacctgactctaaaaatacaaaaatcagataggcgtggtgacactcacctgtaaccccagctactcaggaggctgaggcaggataatcccttgaacctggaaggcggaggttgcaggaagctgagatagtgccactgcctccagcctgggtgacagagcgagactccatctcaaaaataaaaaaaaaaaaaaaggaagaaaagaaacagaagtgttatatagggactcattttttttcaatatggcattgaaatacaaaagtttacctttcaataatgcataataaaagaagcatagaaaggaacagaaagtacagaaaaagtaaaaatgaaataaatatagcaagtaaaatgctgtatcatctgttataaacatcctatttgaagaaaaataggttgacttgcaaatcgctgtgctccattctacttttctattcttaacctaataggaaaacaattatgcatcagggcacctattcattaaataaaacaatgacctgttagggaagtaataagcatgctgtaaatttattactaataataaaactatagaaaatgtcacttattacatctaaatgtttacaatggtaagttcagacagtgataagtagaaaatgaaaggttcatttatttgaatagtatactagaatttcagggaacatagtaatatacatataaaatgcatacagtgttagttaagtcaataatcgaatctggcagtgaaatatgggcctggatttgagagggacagagaaagaattaaaactataaaaatagaagtattgagataattggtacatgtataactgacaaaaaagaaatactagtacttaagaaaaagaaacaaatattttatcattaataacattgtagaagaaatcaggtagatgatgacagaaagatcatgtaggaagcgtaagaaaccaagtgattagaaattgtaaggagagtgaatatggataacaaatgtaatgtaatgaaaactttgaggttacgtatctacagaatggggtctgacgcttataaaagggcttcaagtggagcagctgtattacatgttgggattccaggtagggttgcttaaatgtctcctctcctgccttgcacttgctctatctttatcactcattctgtctatttactttagtccaattccctcattttacagatgagcaaaatgcaaaagagaaggctagtgattgcccaaggtctcacagttagtataaggaataggcctgaacatcatactgtatattacaactatgttagtgtgtaaagcaaagaaatcaagaaggttatatgaatttactgtacctcaagcttatttaaatttggaaagttacttaagttttctttgataattttatttaaaaggcttattaataaatattttccatgttatacaagtgttttgtattatctttagtgattattatttaaatagtctcctcaaaaatagctattaaattatctattaatttctcctcattagttgtaaaatttttatctaaaattggtcatcagaagcaggtcttctcattactgacaatcagtgaaattctactgtattgattgacttttaagtaactgttatcagcactatcgcatttattgtatggtataatgctttctgattattctgcatgttaaagtgtaatggttgttgtaaatctcgtgtataattacatgaattttaaagaaccataaagcacaattctgtggattacaaactgcagtttgtgaaattttgaagttctcaaatcccactttctttttttctttttgtgatttctcactgagatctgacattatataagttgagattttaataaggacaattgatttttatgttgtttgtattctacaatatatagcttaaaatcaaattttattaataataatcaatgtttatgcttaaagggaatacttccacagctccaccaatcctgaatccttatccctgggttgaaatgtgataggagaatatttaaagaaatacatacagggttgatcttctctcatttcttctttaatatcctgataaagcctaggaaatagtttgaatgtccaccaaatacacaatggatagaagatgtctgatccatttttatagcttttcttttaatacataattttagtaataattggtactatgactactaaatgttagttttctaatgaaccatgtatacaaattcagaacgtgagttgatgcatttagaatgttaggtctgtatttatgtattacctttaagtgcgaacacttcatagaaaatagattcacctggtatcaacttcacagaagagggtttatggtctctagggaattttccatgaaattttttttttctattatgttggtttagtgcaaaaagattgtgactaaaccactttttaaaaacttttattttagcttcaatggtacatgtgaatgtttgttttataggtgaatgtgtcatgggggtttatcgtacagattatttcatcacctaggcattaagcccagtacccaatagttatcttttctgctcctctccctcctcccaccctccaccctcaagtagaccccagtgtctcttgttcccttctttgtatgaacaatgcttttaaatagtaatgattgataagttgaaacatgaattatggaaataattatttaacacaacattttattatatataacgtaataaatctgtgcatatgtacattgaaaatattttctcccattacataggttgtcttttcactctgttgattgtttcctttgatgtgcaaaagctttttagtttgcatatctgcatatatgtatataaacagctttactgaggtataatagttacacaaaaactgcacatatttaatatgtataatttgatggatttgaacacatgcacccatgaaaacataactacaatcaaggtaatacatttatccatcacctccaaaagttttctcctggccgggagcggtggctcacacctgtaatcccagcactttgggaggccaaggcgggcaggatcatttgaggtcaggagttccagactagcctgaccaacatggagaaaccccatctctactaaaaatacaaaaaaaaaaaaaaaaggccgggcgtggtggtgcatgcctgtagttccagctactcaagaggctgaggcaggagaattgcttgagcctgggaggcggaggttgcagtgagccgagatcgtgccattgcactccagcctgggtgacagaatgagactccatctcaaaaaaaaaaaaaaaaaaaaaaaaaatttccctcccctttgttgtgcatgtgtgcatgtgtgtttagaacacttcacatgatatctgccatcttacatttttaagtgtataatgcattattgtttactataggcactatgtggtacaacagattgctagaatatattcatcatgcataactgaaactttatggctttggaacaattccccatttcccacttccctcaaaccttggcaaccaccattctactctctgcttctgtgaacttttctgttttaggtacctcatataagtgaaattatgcaggatttttcctatgattggcttgttttacttagcataatgtcctctaggttcatctgtgttgtaacaaatggcagaatttccttcttctctaaggctgaatactcttctattgtatgtgtataccacattttctttatccatttgtacattaaagaatatttgggttgtcttcgtgttttggctgttgtgtatagtactgctatgcacctgggagtgcagatatattttcaagatgctgattgtaattttttgaatatatacacagaagtgattattgaatcatgtggtagtactatttttaattttttgaagaacctccatactgttttccacagtaaatgtaccattttaaatatccattgtagtgtataaggattacaatttcttcacatccttgctaatgcttgttatcttttataaaaattaatagccatcctaacaggtgtgaggtgatatctaattgtggttttgatgtgcatttccctgatgattagtgatgttgaacacctttttatattttttccctttctataggtcaacttttcactctgttgattgtttcttttgctgtggcaaagctttttagtttgatgtagttctgcttgtctgtttttgtttttgttgcctgtgcttttagtgttatttccaggagatcattgccaagaccaattccatgatgcttttcctttatgttttcctctacgagttttatagctttaaatcttctgtttaagtatttaatccattttgatttgatttttgtgtatgatgtaagataaggatccaatttcattcttttatgtgtggttattcagttttcccaacattatttgttgaagagactatcttttccctactgtgtattcttaaaactcttattgaagatcagttaatcatatatgcatgggtttaattctgagctctctattctgttttatttgtctatatctctgtctttatgctagtgccatcctgttttaattatcatagctttgtaatacattttgaaatcaggaaatgtgaggccatcagctttgttcttttttttgtcaagactgctttggctaaacagttgacttttgtggttccacatgaattttagaattttttatctctataaaaatgccatttggattttgatgggtgtaacattaaatctctcagaaactgaatttatgatccctgccatccaacagttagtgtatttatattcatgtttagtgacataaatagcaaactggagcaatggtagatccataaagccaggcgcattagtttgctagggctgccttaacaaagcaccacagactgggtgtcataaacaaatagaatttaattttctcacagttctgggggctggaagtccaaggtcaaggtgttgggcaggtttaatttttattgaggcctttctccttagcttgcagatggctgccttcttgctgtatcctcacacggcttttcctctgtgtgtacatgctgggagagaaagagagagacctctcatgtctattcctcttaataaggacaacagccattttggattagagccaccattcttatgattttgcttaaccttagttacctctttaaagactctgtttccaaatactttcacattgggggttagggtttcaacatattaatttttgggaaacacgatttagtctatagtgccccgtaaactcttatttaagatacaattgctgtacacgaaaataatagaaatgcattaaattggattaaaatatgtgaagaggaatctctcaatccactcaaatattagcaggatgggctttctctggaaagtattgctttagattttgacaggctggagtaatgggtcagttctagaagatgacctgtgctgtataaaagtaaggatctgcacatatattccagaaaccattttagaaatacagaatcggcaagatctagcttaacagcagcacatgagcaaataacctaagatacaagaatacaaggcagggctcaaggtaggtattatgtagtagcaagtagattcctttgggaattgggtacaaaacaaatatattgggactagatattgagagttctggggcatggagtcagttattgggtgggaggacttaggcattcagggacagcagttaagactagaactagtactgggagagtgtatctggcagtaaaatggtggttggggaccctcaaaaggcagacttaatttcacaatttacaccagggtgctaaaaggaaacttaatgaagaaaatgcagtactaggaaatgggacacaaagcaggctacttaactgagagatctgaatcaaggaaaatagccaccaatcaggagagcttgggaaggaggggaaaagtatgagaaagtggcatgaaagaaagaagggaaattacctcaccctcatataaagggagtacaattagtaagggccaaagttgaaaatgacaaacagaggaagaatatacttcaaaatgtacaataaaaaggagtatgtgtgaaagcagagagaaaagtttaatatctagggaagaaggtacaaacattgggttatgatgcaatgtaaacctgcctcaaaaaccaaaaaaccaaatacctacagcttctgcttacaaagtgaagggtatttccaaatatgcatgctattaaatggctataatgtaagtcatggatgagttagtaattcactggtttgtaaacagtaagagctcattaatacctcactgctattcaattataggcctctgcattactgctacttaccctgtccattataagaaattaaagtgtaatcacattgctagctttgtatgtttcatatgtaatataatgtctttactagagaatgctgcttccttttacatcaaacctcaaaaaggtaggttttcttttatacatacagattttggtttttcttggtgtctttaaattttagcattattccctttttgttaaatctcctacatttgcatgatgttccagcaatatattccactacttgaacatagggatactctgaatttttgtgcctataagtaatctcacataattatgtatattatgtaagtaaatatatagcattttgtgtgtatgtatagtaatgaacatccttttttcttttcataatttatttggtgctagattaaacaaaaccctctttcttacaccagaaaacggaattggaagatgtctttatgatgacgagcttatcattagctcatagatcatcctgacaaattccgttttcaagagaaggtccaaaccgaaaaggacatcacagtttgtctccctgacagaggaacagagatagatctgagctttaaggagaaatagcctttgctgttcatttgactgttgttggggttgtggttatcttctgttgtgtatacattctaaagcactgaatattctactgatgttctcctttttaggtgctgaccatctcttgagaagtagaaacttggtgtatagcttgtatgtcttagtgacatggaaaggtgattcttcatttatcaaagagggttctctttgaaattctagtttcataactttctccatcagtctcttctccattttttgaatgtcatttctgttttgcctctggggctattgatctggtctttgccctttcctgcagaaaggaaggctgtcattaaaaaataatgtgaattttcaagtttattcatgtcagctttttttttcacttggaaactgaaaatgggaggagatatgcatatttatctagaattgcgtgcaacttgaagatgttatttaagagcatgtgtttttgtgaagcgttggtcatatgttttaaaaaacaaatatattcaggagcatcatgggaatttatttcattcttgtgcctgtgttggctagtgtgtccactatctcttagctgaaaagcatgttccacattatctgatggttaacactgatgcatgtgcatattgtcccttattaatcacaagcccgcaccttccacactgaatcgtaacaataacggtaaatgacccaaattacttagaaatttcagaataagattaatagccatccctattcttttatttggaatggctgctaataacttagtgaggtggcacatgacagttttttttttgaaatcaggattgttcttatattttattgggatgtaaaatttgtgtatatcacaaaaacataaagaggaagaaattttgtgaaatgctgagaacgcaggatttttttaaactagttcatcattcttttaatcctattcctgaaatgatgatttaatatgaaatcattttacacagcttaagaacaggaaaatgcatgatcatcaagaaagcctatagagtttccccattattggcatcacaaatggtgtgtttactcaacagagctgctttgttgtttctaatgcaacccctgctcaattttttccccacaatacttggagagtccattcctagctttagcagtagtcttgagtgagcttctaaatgattggttagagctggcaatgctgacaggaaatggaaatgttccttgttaagagagtcagagataacttgctcttcatttatttgcgagccctggcattaatattttttattaaaattattttgcatgtactcaattaaaaattgatgaacactctaaaatgagagctagtttgtatatctaaattgatgaacactctaaaatgagagctagtttgtatatctaaatatgctgatcacttgcgttgagcagtgaagtgaacttagatatatcatttcagattcatgttccaatacataattttgttgagattttgtttcaattcaaattcataaggtactcattctctaccattaccacatttggaagccaggagtttatattttttaaattcttgatccagcttattttcatgactctggtaattagtggcttaggatttttgtatttcaaatttatcctgggaattacctagttttagaatttaccaaagagattttcccctgttaattcttttttgcataaagtgtctcaaaatgtgacacaaaattcttctcagtggatattattttgaagttgtttaaagtggatctgaaatgtgattatcttttgcttcacaaggtttctcctttaaaaaaaaagtctatagctaaaaagtagcttatttgccccaaaacatatgaaagggagagggagggagtgttgggacccatcttgataacaacagtcttcctttgtaagatttcattccaggctaatggctggtgaaattgttctgggtagttaaaatgaaataaaatgagttaaagaacatgaagtagagcaagcagaatgggttattgcttttctttgaaggcacaatagccatactctgtctctttttgttattcatatctatgtggcagataaagccagggttttgaatgccatgatggccaaatgaaggctataaattcagagctttggtgcaaaattctgtagctagcaggtactagaacaggatgccaaagatttggattctcaaattgttttaactgatgagtattcacagttgaaaaaaggaggaagcacaattcttacccctctctgagaaacatcatgttagaagtgaaataactaatgttctcctaaaaagtacacttattgaacacagacatgagaaggaaaagcattgtgaaagtcaaaattggtatttctttcaggactgttcagaagttttcctgagaacgctataaaaatgaaggcagttttgaacgtgtaaaaaagtcaaatgataggctatttataattcagttttaaaaagtattcgtctatgtgactgtatcttctttcagtgaacagaaaaggacttttaaatgtctggaagcttgcagctatcaatgcaaaagtttcatgaattagtataatgaagtggaaaaaagtacctggttttacagtgttgttacacagctgaaaaaaaaagtgtcatatcaggttgggatcacatttgtctaagaaaaaaataacatgagtctttcttttgtcaacacaagagataagctgtatgataccgggaaattatactctctgatctagccttctcttatggaagtaactagagattaaagtctccatctagagttgcattacttttatacagtttttatgtaaggcaatttttgcaagagaaaaatactagcaaaaaaggtccaaatttctttacaaaatcacaagtccatttggaattctgcatttttatttctttctcctggtgttatgatatgtaaacaaagaaaagccaagtattccaaattaagaagttgtatatatggataccttgtgcttctaatatgtctttatttatcatatgttgtgtgtgaaaaaatttgcatattgtttactccaaataatctaatacatattatagtgtgaatataatgtcattggcaaataacactaatttcctattaaaatatacttttaacactaactagatacaaatcctgttataaaaataaaaataccttattttttgaaaatttttgtccttgtcttttagttataagtttagtcatttcatttgggagaaaagtaatatcctacccactctttcaagattagtattctttcaaatatatttactatgaaaataatttaatggatgaaattattaggcacttaaaaatactggtttacatttattggacatatcctatgtgcccaacaccaatattcattttaagccaagcacaataatatgaaacgggttttatgatgtgtaaattatctttcatgtgtttttgacactgttattcatgtgtttgcctttttactaccgattagggatacatgaaatatgccatgctggtttacaaggacttagttttctacttgtataaagagtgtttgtccctgtaccctttggtatgtttactcaatttctttacttggttttatttatctcaccaccaaatgatacaaaattttctttattttgtattgttcctgtttatgttaatcattctttcagccatactctctatggtagtctttgaagaacatcaaaaggtactcattcaaccaaaaatatttgtcccttcccatgagctagcttgtttcttgaaattcccagcattaggcaaccccctcgcccatcttggcattcacacctctgttaaaatgctgatagattctttttttttttttaagttttcaaatttagtagcccttactaccacttacattgcacccttcctttcttttcccttctatttcctgtcctatgctattcttcttttaaaaaaaatgctggtcacaacctactaaattattttaataaacaattactaaagaggatcaacccatcatttgaaaaacactaacaatatttaacctgacttaaagaaagttacatttaaaaccaacttaaatacatttaaaacatgtattcttttacctagaataatctttgtttttgagccagtcagtaatgcaatgctgatttctttttttccaaatccttattatttattatttttttaattttatttttccataagttattgaggtacaggtggtatttggttacatgagtaagttctttagtggagatttgtgagaacctggtgcacttatcacccgagcagtacacactgcaccatatttgcagtcttttattcctcgcccccttccactcttacccccaagtctccaaagtccattgtatcattcttatgcatttgtgtcctcatagcttagctcccatatatcagtgagaacatacgatgtttggttttcgattcccgagttacttcacttagaataatagtctctaatctcatcctggtcattgcaaatgctgtatatgtacatacatatatatcagagtttctttatccactcgttgattgaagggcattttggttggttccacgattttgctattgtgaattgtgctgcagtaaacatgtgtatgcaagtatctttttcaaataatgacttcttttcctctgggtaaagaggaaaaaaaaaaaagaaaaaagaaaacccagtagtgggtttgctggatcaaatggtggttctacttttagttctttaagaaatctccacactgttttccatagtggctgtactagtttacatcctcaccagcagtgtagaagtgttccctgatcatcgcatctacgccaacatctactgttttttgattctttgattatggccattcttacaggagtaaggaggtattatattgtggttttgatttgcattttcctgattattagtgatgttgagcattttttcatgtattttttggccatttgtgtatcttcttttgggaattgtctattcatgtccttagcccactttttgatgcgattgattgttttttttcgtactgatttgtttgagttagttgtagattctggatattagtcctttgtcaaatgtaaagattgtgaaggttttctcctattctgtgggttgtctgtacactctgttgactgttccttttgctgtgcaaaaactctttagtttaattaggtcccagctatttatccttgtttttattgcaattgcttttggctttttggtcatgaactccttgcctatgccaatgtctagagggtttttttctgattttatcttccagaatttttacagttttaggtcttaggtttaagtccttaatccatcttgagtggatttttgtgtaagatgagagatgaggatccagtttcgttctcctacatgtggctagccagttatcccagcaccatttgttgaaaagggtatcctttcctcactttatgtttttgtttgctttgtcgaagatcagttggctgtaagtatttggatttatttctggattctctattctgttccattggtctatgtgcttatttttctgccagtatcatgccattttggtgactatggccttatagtatagtttgaaatcaggtagtgtgatgcctccagttttgatctttttgctcggtcttgctttggctatccaagttcttttttggttccacatgaattttacaattgttttttctaactctgtgaagaatgatggtggtattttgatgaggattgcattgaatttgcagattgcttttggctgtatggtcattttcacaatattgattctacccatccataagcatggatatgtttccatttgtttgtgtcatctatgatttctggtagcagtgttttgtagttttccctgtagaggtcttttgactcctttgtgaggtatattcctaagtattttttttttttttgcagctattgtgaaaggggttgagttattgatttgattttctgcttggtcattgttggtatatagaagagctactgatctgtgtacgttaatcttgtatccagaaactttgctgaatttttttgtcagttctagaagctttctggaggagtccttagggttttcaaggtaaacaatcatattgtcagcaaagagggtcagtttgacttcctttttactgatttggatgccctttatctttttctcttgtctgatttctctgggtaagacttccagtactatgttggagtggtgagaatggcatccttgtcatgttcccgttctcagggggaatgctttcaacttgttcccattcagtattatgttggctgtgggtttgtcttagatagcttttattacattaaggtatgtcccttgtatgctgattttgctgagggtttttttcagaaagggatgctggattttgtcgaatgctttttctgcatcctttaagatgatcacgtgatttttgtttttaattctgtttatgtggtgaatcacatttattggcttgcatatgttaaaccatccctgcatccctgggatgaaactcacttgatcatggtggttggtttttgatatgttgtggttgatatgttttttgatatgttgttggattcggttagctagtattttgttaaggattttggcatctatgttcatcaaggatattggtctgtagtttccttctttagttgtgtcctttcctgcttttggtattagggtgatgctggcttcgtagaatgaattagggagggttccttctttctctctcttgtggaatagtgtcaaaaggattagtaccaatttttctttgaatgtctggtagaattctgctgtgaacctgtctggtcctggactttttttgttggtaatttttaaattaccatttcaacctcactgcttcttattggtctgttcggggtatgtaattcttcctgatttgagctaggagggttgttttttccaggaatttatccacctcttctaggttttccagtttatgtgcataaaggtgttcatagtagccttgaatgatcttttgtatttcagtgttgtcagttgtaatatctcctatttcatttctcagtgaggttatttaaattttctctcttttttccttaggttaatcttgcaaatgatatatcaatcttatttatcttttcaaagaaccagcttcttgtttcatttatcttttgtacttttaaaaatttcaatttgtttagttctgctctgatcttggttattccctttcttttgctaggtttgggtttggtttgttcttgtttctccagttctttgaggcatgaccttagattgtctgtttgtcctgtttcagactttttgatgtaggcgttagggctatgaactttcctcttagcactgccttagctgtatcccagaggttttcataggttgtgtcattattgtcattcaaactgagggttcttagctttggtggtttaatgctctatttttgtgctggtttaccacctgccaggaggtggcactttccaaaaagcatcagctgtagtagtgtggagagggactgtcagtgggcagagccctagagttcccaagattatatgtcctttgtcttcggctaccagagtgggtagggaaggaccattaggtaggggcggggctaggtgtgtctggactcagactctctttgggcaggtcttgctgtggctgctgtggggggtgggggtgagattcccaggtcactggagttgtgtacctaggaggattatggctgcctctgctgagtcatgcaggttgtcagggaagtggagaaaatccaccgaaggcctggtctcactcccaccgtgccacctgcaacaaccccaagtctgtttccaggtggagggcaggcttaaaaacttgcccgaggctttctgccacccagctgtgagagaaaagggctttagttcttcccctgcctgtgaagtctgcaagctggattcacaccctcccctgagttctgaccaagaggcttttcatcccgctcaaattgttacaaagttcagctagggaagtccttctcccctgtggggttttaccccttgtcctctggcctccctcctgatggatccctgtggtgccaggcaggaatgggttgcctggggggttggtgagctcccagggcctccctgctgccttctccacccctgtatttcgctcagcttggctctctaacttgactcagctccaggtaaagttggaacatctcctgcaaacagactttcagcttctccagtgggggtgtgtgtttgggaaaggagcaaaatgctgatagattcttgagggtaggcctagatggtgtgccattgtacacaagcaaccctgggcatgttgactctagatgaccagtagagagcaggccaattgggaaaaatcaagttgacgatcttgaaaagataacatatacacaaatcaactgaagatggaataaagacttaaatgtaaaacccaaaactgtaaaaaccctggaagacaacctaagcaataccattctggatatagaaactggcaaagatttcatgacaaagacaccaaaagcaattgcaacaaaagcaaaaattgacaaatggaatttaattaaaaaacttctgcacagcaaaagaaaccatcaacaaagtaaacagacaacttatagaatgggagaaaatattcatgtactatgcatctgacaaaggtctagtatccagcatctataagaaacttaaatttacaagagaaaaacaaacaactgcattaaaaagagggcaaaggacatgaatgaacactttaccaaagaagacatacgtcagccaacaagcgtatgaaaaaaagctaaatatcaataattattagagaaatgcaaaccgtaacaagataccatctcacaccagtcagaatggctacttaaaaagtaaacaaacaaacaaacagatactggcaaggttgaggagaaaagggaatgcttatacgctgttggtgggaatctaaatgagttcaagtattgtggaaagcaatgtggtaattcctaagagagctaaaagtagaactatcattcaacccagcaatctcattactggatgtatgcccaaaggaatataaattattcgatcataaagacacatgcacatgtatgttcattgcagaactttttacgatagcaaggatatggaatcaacctaaatgtccatcagtggtagactggataaagaaaatgtacatatacaccatggaatgctatgcagccataaaaaagaatgagatcacatcctttccaggaacatgaatggtgctggaggtcattatccttagcaaactaatgcaggaacagaaaaagcaaatactgcttgttctcacttataagtgggagctaaatgatgagaacatgtggacacatagagaggaacgatacacactgggtctataggagggtgaagggtggaaggagggagaggatcaggaaaaataactaatggatactaggcttagtacctgagtcatgaaaaattctgtacaacaaaccccatgacacaagtttacctatataacaaacctgcacatgtacacctgaacctaaaatacaagttaaaaaagaaagaaagaaaagataccaaagacaagcctacttcaattcatttgcctagttattaacaccaactagttgatgtggtgagttggaattttgaactattttcagagttaccaagaatgcaactcttttggaccatccatttaaactggtttccaggttgggacttgaaatcccaacttacggcaagagttaatctcatctgctctagggtgaaagatagtaatgaggataaacctagagaaataaagaaagttgtgtctctgggagagtttcaggtagactagagggagactgtattagtccattttcacgctgctgataaagacatacccgagactgggaagaaaaagaggtttagttggacttacagttccacatggttggggaggcctcagaattgtggcaggaggcaaaaggcacttcttacatggtggcaacaagagaaaatgaggaagatgcaaaagcagaaacccctgataaaaccatcagatctcgtgagacttattcactaccatgagaacagtgtgggggacactgcccctgtgactcaaataatctcctaccgtgtccctcccacaacacgtgagaattatgggagtacaattcaagatgagatttgggaggggacacagagccaaaccatatcagagactttgtagaggaaatgctttattggaaaatggaggatgagcagttcctcattgtaggtgtttatggttcaggatagtagataaacatctctctgcatttatctttcactttgtaatgtacttttcacagagataaactaaggagacattgcactttgaatgaagaggatttaaaaacatggcacacattgccccctttgaaacccttggacagtgacatgtgcatatggaatgagtggtgaccacatcaagaagactaaatataatttgatgtattttgagaagcttcaagctgatctacaacaattggtattctttctataatttcagctaacattactttatgatatgaactctgcatacaaattaatctgaaatactcaatattctctaaacacatactactctctaccaaaatattacactggtcacccccaaccccatttttatagacttatttttaggacagttatagattttcagaaaaatttagaagtacagagaattctcatatatcctgtacctagcttcccctattgttaccatcttaaattaatatggtaaatttcttataattaatgagctaatatttctactttatttatattttaatttaattttttttttttgagacagagtcttgctctaccacccaggctggagtgcagtggtgcgatctcggctcactgcaacttcttccttcccgactccagtgatcctcccacctcagcgtcctgaatagctgggattatgtgtgtgcaccaccatgcctgctaatttttgtatgttttgtagagatagggtttcgccaagttgcccagactggtctggaactcctgggctcaagctatctgcccgcctcgacctcccaaggtgctagggttatagccatgagccactgcgcccagcccaatatttgtactttagtattaactaaagtttatactttattcagaattccgtagtttttacctaatgtccttttcctgttctgtgatttcatccaggataccacattccatttagttgtcatgtttctaggctgctcttgtctgtggcagtttctcagatttgccttgtttttgatgacctttacagttttgagtactggtcaggtattttttagaatattcctcaatagaatttgtctgatgtttttctgatgataagcctgggtttatgggttatgggagaaagaccattttcatcacatcatgtcaagggtacatactatcagcatgatttataactgtagaggctgggctttcataataaagttttaaatctttggtttaccttgatgtcttgtctagtattccaccattttctgtcatcagcccacgctgaaactatactgacctccatgtacagctatacagtacttcttgctatttcacgtctttacacatgcgtttccccgcttaccttccatcttcacctaggtcatgcattcatatttttcagaaatagcacatttgctgggatgttgctgctcagtcataattagatgacctccttctctgctaactttggagctaatacaaaatgttccattggctgaaactttgagtactaacatgatgccacatgggtagcagaggtagtaacgcctttgctttctgatagttcaatgtacaaaaactttgtttcatgcacaaaattatttaaaatactctagaaaattactttaaggctatgtgtattaggtgaatatgaaacattattccatgtttagacttgggacccctcctcaagatatgtcattatgtatctgaaaatcttccaaaatccaaaataatctgaaattcaaaaaacttctgttcccaagcattttaggtaagggatactaggctgggcatggtggttcacacctgtaatcccagcactttgggaggccaaggtgggtagattacctgaggtcaggagctcgagaccagcctggccaacatggcgaaacagcatctctactgaaaatacaaaactagctgggcatggtggtgggtgcctgtaatcccagttactcaggaggctgagtcaggagaatcacttgaacctgagaagtggaggttgcagtgaggcaaatcgtgccactgcactccagcctgggtgacagagcaaggctccatctcaaaaaaaaaaatatagataagggatactaaatccgcacaacactttccatatttctatacagcacctattaagctgtttgataatggttttgcttgtttgactttcccactggatttaagcaccaggacaagaactatgtcttatttgtgtttgtatcctcaaacagcaacgtcttgtacattgtggacacataagtgcttattgaatgaatacatgaataaagaagtgaataaaataactctgaagctgaaaacaaaattgttaacacaagcccatacgttatatatttaatatacagtcatgcatcatttattgatggggatacattctaagaaatgcataattcggcaattttgtcattgtgctagggttatacagtacacttacacaaatttcaatgaaatagcctatgacacacctaggctatattttacagcctattccttttaagctataaacctgtacagcatgttactgtactgaatactgtagacaattgcaacactatgctatttgtgaatttgaacacacctaaacatagaaaaggtacagtaaaaatatggcataaaagatagaaaatggcacatgtatatagggcaccatgaacaatatgtggactgcaggtcacactgggtaagttggtgaaggagtggtgagtgaatgtgaagtcctaagacattactgtagactttacaaacactacatttagactacaccaattttactttaaagagtttatttcttgaataataaattaaccttagcttattgtaattttttactttacgaacttctatatttttaaaaaactgttttacccttttgtaataacacagcttaatacagaaccacattgtacaattgtacaaaaatattttctttctttatatatttattctataagctttttcctattaattttttaaaacagtttaaactttcttgttaaaagttaagacacaaaaataaacatgagcctaggcctacacagggttgggatcataaatgtcactgtcttgcactgaaagttcttctggcgcaataacacacatagggctgccatctcctgtaataacaataccttcttctgtaatacttcttgaaagatctgcctagggctgttttacattaacttttttttaataagtagaaggagtacactctaaaataatgataaaaagtacagtataatacatacatgaaccagtaacatagtcctttattttatcaagtaccatgtactgtaaataattgtatgtgttatactttttataggactgtcagcacagtaggtttttttacaccagcatcaccacaaacacgtgagtaatgtattaaatcatgacacatcgacagctatgacattgttatgggatccctggggtgtgctttgtcatccagaaacctctgtgtctggtggcgcctctgcccgagtttttacttgagcccactgttcttgttccacccatttggcctggcaggctgtgctgggcttgtgctactggcccgaatctcacacatggcaagggaagccagctgtggagcggcaaggggtgtgtgagtgagtgagcatggggtctggccactgcacatggctgggcatgatggctgcggtggggtgggtagctccaggcactggcatggacactggctccctgtgaggctgtggctgaaccaggcctaaccacaagcagctttcatggctgacaccaaggaatgcagtggtgactgcaagcttggagatgtcaggaatgacagagccccaaagagactgtcacagccatggctcaaggagctcctaggtctgggctccccgaagtgccacagctcttctctccttcttatctcgctcaatgtggtgagcaaggggcatgtttcagccctgtttgtgttaaagctctttcaaccctgccattcagcaggtcccaagttcttgtcccatgccgagttatattttatttgacagattttagcagggtcatattcacaataataaatatttcacagttctaatgatttaaccctaatcactctttttacctcattgaactcattttgtgtatcttttagatgctatttggcaggatcccttttctaaatgccatcagatttctcctaatgatatgggaagcattcagaatatgtttctggcaatccagggtgatattttaaatagtggcattgttcttgattttgttttgtgctaaccaacttttatatatagctttgtctttattggaaggccttcaaatattttcatagcactagacacatgtgatacattcttacaaggagctaatgaagtcctttgtagcaaagaataaaaggccaaactggtagtttttcatagttataaaacctactcttaaactttgaaaatgatatatatgtcaataaaaatatttataatgttccagcataagtcattgcccatttattcaactgcttcaacagtactgcattcaaataatgaaaactcaacattcaaatggtgtttaataaaattgctctctgcctctctctgattgttatcttggatgaaaaagcaattcagatataataatagcttgcatcatataatgaatgtgtgtccctaccagtacataatgaaagaacatgaaattaatacaaataaaagctttatttttttgatatcagttgtatgctttctttttgtgttcagttgattagtgggataactaaattttatattaaaattcaataaaatgttttttatttaaaaatatcaatattgttcttaaacaagcaaatgtaaatcatgataagataattcagctacaacaggatggcattagtgtgttgtatatttatgaggattaatggggtgactgctaaaagtgagaagcactagaaactcaaaaaagtaaagaatttgcatttttgtagccagtgaaccacttctctgctaacagagaaagcagtaaggtgacaatcccaaattttattcattatagcttatattagttgatgtagtattattttagtattatttgctttgatgggataaagcattcatagtttttggtttgagctttgaagtaactgatttagattgttaattttttattgaactataaagatgagtgcagaaattataagtatacaacttcgctgatttttttgtgagggaaatacacctgtgcctgtgtagccagcaactaggtcaacattattagcatgcagaagcccccctttttaccccattttagatactaccacctgccaagggacaatatgtatctaacatttatgtatttgtttgcctattactgacctatatctaaatagaatcacagaatatgtagtcttttgcatctggcttcttttattcatcagtatgtctgtaagattcatcctcgtttttacatgtagcagtagttcattctttttattgctgcatagtatgccattgtatgaatataacaaagttcacttactctttctgctgttgatggactttgggttgtctctaatttaggttattttaaatgatgcctctgtgagcagtcatgtgtgtgcctttgtatcttttggtacacatatgcactaattcttgttgactatagcattgctgtatcatagacttagtcttgttttaagctttagtagatgatgccatatagctttagacttccatcagcaagcagagtatgagagttccagtttctccacattgtcattaacacttggtgttatatatctttttcattttagccattcccctgggtgtgtaatgaagtttgttagaattattagatcaggaaaatatgtgtctgcatggaggattttaaataatgaaaattctgttcagtgaacatgtgtaggtgatagcccaatagtgagtgtagaggcctctggctgggaagaacaagtgtccttcttgtgttacaatttctctgtggcttaatgtcattcacttcatctcaacatttttatctcaccaattataaccaaaagcaagcaacttccaaaactgattctacttaaactgtcatttgaagccagtcttggaaggtagagtgagtcctggaacagaaatctttatagtagttttgaaagattaacctggttaagctcaatttagaattgtaaacatacgctcatcacaccagagagttttgttgttttgggtggatcagcaagtagaatctggattttgaaagcctaagaaacgttttggaatgttaaagttggctatcctcaaactcaaattatttgagttaaagttattttgcaattgaatgcaagaagaaagtatattcatcaccatggtggttgtatcagattattattattattattattattattattattattattattactttttgagacatagtcttgctctgtcacccagtctggagtgcagtggtgcaatcatggctcattgcagccctgaccttgtgggctctagtgattctctgcctcagcctccctagtagctgggactataagcacatgctgccatgcctggctaatgtttatttttatattttttttgtagagatggtgatatggtttggctctgtgtccccatccaaatctaatgtcaaattttaatacctacatgttaggggagggaccaagtgggaggtgattggatcatgggggtggatttcccccttgctgttctcatgataattaagtgtgttctcacaatatctgatggtttaaaagtgtgtggcacctccctcttctctttctgtctctctcctgctatgccatggtaagacgtacatgcttcccctttgccttccaccatgattgtaagtttcctgaggcctcctagccatgcttcctctacagcctgtggaactgtgagttaattaacttattttctttataaattacttaatgtcaggtagttctttatagcagtgggagaatggactaataaaaaaattgatgtcagtagtggggcgatgctataaagatgcctgaaaatgtggagtcaactttggaactgggtaatgggcagaggttggaacaatttggaagtctcagaagaagacggggagatgtgggaaagttttgaacttcctagagacttgttgtatggttttaaccaaaatactgatagtgatatggacaatgaagttcagtggcctcagatggagatgaggaacctattgaaaactggagtaaaggtcattcttgctatgctgtagcaaagggactggtgccattttgcccctgccctagagatgtttggaactttgaacttgagagagatgaatcagggtatatggaggaagaaatttctaaacagcagtgttcaagatgtggcctggctgcttctaacagcatatgctgatatgaatttgtaatgagattgtctgaaattggaacttatatttaaaagggaggcagagcatgaaagttggcaaaatttgcagcatgatcatgaggtagaagagaaaagcccatttcctagggagaaattcaagcgggctgcagaaattttcataaataaaagaagctgaatggtaatagccaaggcaatgggaacattctcaagggcatgtcagagactgtcacagcagcccctcccatcacaggccctaaggcctaggaggataaaatggttttgtgagccaggtccagggctcagctactctgtgcagccttggaacatgatgccctgcactgcttcaggtccacctgtggctaaaagggaccaaggaacagctcaggccatggcttcagagggtacaagtcccaagccttggcagcttccacatggtgttgggcctgcaggagcacagaaggcaagagttgaggtttgggaacctccgcctagatttcagaggatgcatggaaacatctggatgtccaggcagaagtctgttgcaagggcagagccctcatggagacctctactacagcaatgcagaggggaaatgtgggcttggagccctcacacagagtccccaatggggcactgcctagtggagctgtgagaagagggctactatcctccagaccccagaattgtaggtccactgacagcttgcaccatatatctggaaaagctgcaggtactcattgccagaccatgaaagcagccaaaggtgctgtaccctgcaaagctacaggggtggggcttcccaaggccttacgagcccaccccttgcatcactgtgtcctgtatgtgagtcaaggagtcaaaggagattattttggagctttacgatttattgagtgccctgctgcattcagacttgcatgaagcctatagccccttcgttttggccaatttctccgttttggaatggtagcatttacttaatgcctgcacccccattttatcttgaaggtaactgaattgttttggttttactggttcataggcagaaaggacttgccttgtctcagatgagactttggacttatttggacttttgagttaatgctggaatgagttaagactttgggggactgttgggaaggcatgactggttttgaattgtgagaaggacatgagatttgtgagaagccaggggctgagtgatatgatctggctctgtgtcccctcccaaatctcatgtcaaattgtaatccccacgtgtcaggggagggacctggtgggaggtaattggatcatgggggatgggtttctccctagttgctcttgtgatagtgagcgtgttctcatgagatctgatggtttaaaagtgtgtggcacttcccccttctttctcctgctccattttggtaagatgtgcttgcttcctcttcaccttccaccgtgattgtaagttttctgaggcctcatagccatgcttcctgtatagcctatgaaactgtgagtcaattaaacctcttgtctttatcaattacccagtctcaggtagttctttattacagtgtgagaatggactaatatagatgggggtctcactatgttgaccaggctggtctccaacagagtagtattattttacttcttgttcttcattctttcccacatagtttttagaattagatgacatagtggttactaggagctgtgggagctggagttggtagaaaatggggagataaggatctaaagatacaaaggagcagatacataggaaaaaaaagtcgagagatctaatctaccacctgaagactatagtgaataaaatttttttggattgggaatatttgtcaaataggtagattttagttacttttctaaagaaagtaactatgtgtgatgataatatgtgttaatttgtttcactataataaggattttactatttccatgccataacatcattttgtaaacctcagtcacactaaaattcatgtttttttaaaaaataactggatcatagtgaagagatagtttctctgtcagttttcattttctggtcattacctgtgtaagagagatttttttttctaccttaatagagtatcttgatttggtaaattgcccactattcagagacagtggatttatacagaagcagagaatattttctttgttgttatcactactcaggattctctccaagaaaagtgtgctccctgcagtctctggttatttctttagttcatcagaataagactgtaagtaaagcatagaaagaacatactgtcagtaaagcatagaaataaatcagatcaatgtttgtgaagtttaatttattatagactattcaatcaggtcacaaattaattcgggggtgtaattttcttcagagtcctggaaaccatttagatctttccatatgaagcatctgtacttcatcacctttacattaggaaattggcagtattttatagcattatattaaatatttaataaaaattttgtattgataatttagaataatctatttttattttcttatatatcaatatctgattatctgggaaattcaatgaaccttttacattcacaaagcaacatttgtatgtttggcctactgtaatacattttaataactgactattttgcattaagatgtggaaattattcttaaaggggttttatttgttaataggtcctaagtgaagccacatagcaaagccaatcaaaaagattgagtacatcaatctgagtttattgcagttctacactgaatttgaacaggggacaaaagcctttctgttctataatcatcctctgagtcaattgattatcccaatactatcaatacttcttctaatactgaataaattcgtgggaagatacaatcatagctaacttagggatggtgcaaggaaaattattttattagatggaggtgtaagcagtgtgttgtggcagaaggaagaatagaagacagaaaatatccaatttcctccaaaattagctgggcatgttggcatgcacctctagttccagctactcaggaggctgaagtgggaggatcgcttaagcccttaagtttgacactgcagtgagccacaattgtaccactgcattccagcctgggcagtagagtgagacgccatctctaaaaataactctagtcttgggttggctgaacctgttgctgtctgtgtgacatgcaactcacttaacttctcttgatcatagcttccttgcctgtaaaatgaagagaaatattcactgttactaccttaaatatttatcacaagcattaaaaagtttttcaaatttataatactctgtagacaacacattataattagaatttcacaatctgggataaagagattgccactaaaaattattatagaaacagaaaatacttgcttcccaatgaacatacattatatgtaactggtgaaataagtaaaaacaaactagaaaaatacatctatcaccttgtattatatgtagatatgcagtctttattatttaataaggtttgcactatcagtaagatatagtctggtaaaggacttaaggcaggactgtaagaacaacaaaattaaggttattacagaaaataatataagatataatgtgataaaaccaatacaacaaattgtttttatagctattataaaagctgttattgttttataactgttatagctgtcttactttgaagaagcattgaaaaaaaactcagtgttcctgctggcagtaatgtaccccaccccgccactgtcaggacatgtccatgcacaggcactgccacagagccacaactggtgcaagtgcatgcttgcattccccaccaccctgacaccacctatgcatgcttatggactctgttgctccactactgctggcacatgtgcacgagcatggaccctgctgtcaccacctgatgaggtgcttttgctggtaactccccatcaaaatgttgttgccagtgtaccaggaacaccttgcccctttagagcagaaggtgtttaaccttgagggaccagagaacaaattcatgggcctggtactagccccgcgaggttatagcatgtagcccaggaatgctgagctgatctttggtcccctgaaaccagccagaaatgaaagcagttgactgaatcaaagttatactacagtcaaatcttcaaaggcataaaagaatataaaagcaaaaaatcccatccaaaaaacagcaacattaaagattaaatgaatatcagcccacacaggagaaagaaccagcacatgaactctggcagttctataagccagaatatcttgcctccaagcaaccacactaactctccagccatgatttttaaccaggctgaaatggcagaaatgacatatagaattcagaatctggatagtgacaaagataatcagaattcaggtgaaagttgaaacccaatccaaagaatcttaggaatctaataaaatgttacaagagctgcaagacattttaagaaagaaacaaactgatctgatagagctgaaaaataaactacaggaatttcacaatacaatcagaagtattagcaacagaatacaccaagccgaggaaaggatctcagggcttgaagactggttctttgaaccacctcaatcaaataaaaataaagaaaaaagaataaaatggaatgaagaaagtctccaagaaatataggattatataaagggaccaatcatatgaacattggcatccctgaaagtgagggagagaacacaagcaaattggaaacatatttgaagatattgtccatgaaaaatttcccaaacttgcgagaggtcaacattcaaattcaggaaattcagagaacccatgtgaaatactatacaagaggatcatccccaagacatatagtcatcagattctccaaggtcaacaggaaagaaaaaacattaaagacagctagagagaaggggcaggttgcctacaaagtgaactctatcaggctaacagtgaacctttcagcagagacgctataatccagaagagactggggtcatatattgagcattgtggaagaaaaggaattccaaacaagaatttcatatctggccaagctaagctttataagtgaaaggtgaaataagttccttttcagacaagtaaatgctaaaataatttgttaccaccagacctgtcttaccagaggtccttaagtgagtgctaaacatggaaatgagacagttaccagccaccacgaaaacacacttaagtatattgccaaaacatactttgaccattgacaatacaaagcaattatacgatcaagtctgaataacaaccagataacagtgtgataggatgaagtccacacatatcaatattaaccttgaatgtaaacaggctaaacaccctacttaaaaggcttagagtggtaagttggataaagaggcaagacccaactatttgctgtctttaagagacccctttcacatgcaatgacatggataggctcaaagaaaagggatagagaaaaatctaccaagtaaatgaaaaacaaaataaaagcatgggttgctttttaatttcagacaaaacaaattttaaaccaatgaagatgaaaaagacaaagacaggcattatataatggtaaggttcaattcaacaagaagacttaactattctatatttatatgcatctaacactggagcagctagattcataaagcaagttctgtgaagttcctaacatcacatgtagaggaactagaaaaacaattgtgtaccaaccctaaagctagcaagaaaagaagtaaccaaaatcagaactgaactgaatgaaattgagacatgaaaaaccacacaaaagatcaatgaaaccaaagttggtccttttaaagaataaatagatcaatagaccactagctagactactgaagaagaaaaaaagagaagacccaaataaaaataatcagaaatgacaaaggagatattaccaccaactccacagaaattcaaaaaacacccagtgattattacaaatacctttatgcatacaaactagaaaacaatagataaattccaggaaacatacaacttctcaagattgaaccaggaagaaattgaatctctgaacagacttataatttatgagttccaaaattgaatcaataatctatgttcatagatatgaacatagattcattaacatgaacatagagggcctcctccctgactcattctatgaggccagcatcattctgatacaaaacctggcagagacacaacacaaaaagaaaactttaggccaatatccctgattaacgtagatggaaaaatcctcaacaaaatactagcaaactaaatctagctgcacatcaaaaagcaaatccatcatgatcaagtaggctttattcccaggatgcaaggttggctcaacctatgcaaatcaataaaggtgattcatcacatagatagaactagaaacaaaaaccacatggtcatctcaatagatgcagaaaaggttttcaataaagttcaatatcccttcatgataaaactctcaacaaactaggcattaaaaaaatacctcaaaataataagggccctctattacaaacccacagccaacattatactgaatgggcaaaagctgcaagcattcttcttgagaactgcaacaagacaagtatatccactctcacagcttctgttcaacatagtactggaattcctagccagagcaatcaatcaggcaagagaaagaaataaaaggcacccacataggaagagaggatgtcaaaataactctcttcacagacagtatgattttatacctagaaaaccccatagtttctgctccaaagctcctagatctgataaatgacttcatcagtgtttcaggatacaaaatcaatacacaaaaatcagcagcatttttatacactaacaacctccaagctgagagccttatcaagaatacaattccatttacaatagccataaagaaagaaaaatatacctaggaatacgcaaatgaggaaggttaaatatctctacaatgagaattacaaagcactgctgaaagtaatcagagatgacacacacaaatggagaaacacaccatcctcatggataggtagaatcaatattgttaaaatggcgttactccccaaagcagtgtatagattcaatgctattcctatcaatctactaataccatttttcatggaattagaaaaaattgttccagaattcatatgaaaccaaaaaagagctcaaatagctgaaacaatcctaagtaaaaagtgtagagcctgaggaatcaccatacccaacttcagactatactacaaggctacagtaaccaaaacagcgtggtacttgtacaaagacaggcacacagaatgatagaacgtaatagggaatccagaaatcagattgctttattgcacacccataaccatctgatctttgacaaagtcaacaacaaaaaaagcaatggggaaagaactccctattcaataaatagtgttgggataactgactagttatattcagaaggttgaaactggaccccttccttacaccatacacaaaaatcaacacaaaatggattaaaaacttataggtaaaacctacaacttaaaaaaccctagaagaaaacctaggacattctattctgtacatagcccttggcagagttttcatgacaaagccttcaaaagcaatttcaacaaacaaaaactgataagtggggcctaatttaactaaggagcttttgcaaatcaaaagaaactattaacagagtaaacagacagcccacagaatgagagaaaatatttgtatcttatgcatgcaacaaatgtctcatatccagaacctataaggaaattaagcaaatgaacaagaaaaagaaacaccctattgaaaaatgggcaaaggacatgaacagatacttctctatagaatacatacacttggccaacaagcatatgaaaaaatgttcaatatcactgttcactagagaaatgtaaattaaaaccacaatgagatatcatctcatactagtcagaatggctattattaaaaagttaaaaaatcacagatgctggtgatgctgtagagaaaatggaacacttatacactgccggtatgaatataaattagctcagccactgtgaaaagcactttggagatttcttgaagaccttaaaacatatctaccacttggcacagcaatcctattactgggtatatacccaaaggaatataaattattctaccattaagacacatacacatctatgttcatcacagcactattcacaatagcaaagacctggaatcaatctatatgcccaccaatagtggattacataaagaaaatatgatacatatacaccatggattactacacaaccataataaagaatgagatcatgtccttttcagcaacttggatggagctggaggttatcatcctaagcaaattaatgcaggaacagaaagcaaatactacatgttctcacttataagtggaagctaaacatcaaatacatatggacacaaagaaggaaacaacagacacctgggcctacctgatggtggagggagggaggagggtgaggaataaaaaattacctatcaggtagtatgcttattacctgcgtgatgaaataatctgtacaccaaacccctgcattccacaatttacccatgtaacaaacttgcacatgtacttcgtgaacctaaaataaaagttggaaagaaaagaaaaactcactgtgaatactgtgccatctattcttcccatccttggccaaggaattaacgtaattgggaagatttgagattatcaaaggtaaaccattaaaatgttgtcaatgtggtcattttatatgcactggcagggtatatttgagaactgagagtctattattttggtataataggaatttcaatatgtgcctattacaggtatttctagttcagagtattgcttcattcttggccaataaatcaatattgttatatggatacacaaaaaatcaactggagttataaaaacaattgttaataatactgcatattttatgccactttgtactattttaaagtgattttacatattttcatattttcttcatttgaagtcattacacattttggaaatgttttctgagtgctatacattcttattataaacagtgtttaaaggtaactacaaagttctaagagtggggaaattaggatatatcatttcaaataacattcatttggtttttaagttaatgttgctgataagactctgcaatataataattcaatgaatccacagtaatttaacaccagataaagaatttataatattgttctttctgggttgttacatctgcttttaaaggtaagtggagcattaacaactgaggctacagcattgattataacattgttattgtaaaaatctcactgctgttgtcttaattctaagataaaataaagttcagcctacctttcaatcaggtgattaactttctggagctgcaattgaggtttccagtttcaaaaaggtaggtgtgcctgtaggtatcctgacccctaacttttatagatgctgtaggcatcagatacttacttgcattgtctttccagtagtacaatttgtccacaccttccctgagcataaaaatgttattaaaagtatgtaaagcatagttgtccgttaaaaatagagatacattaaatgaggcttggagatggtctaagaaatctccatggtttcatggcgatatcaaagttgtaaaagcagcaaatttcttctaagtttcattaaatgaagaaatactttagtctgtttggaatcttctctgttatttcattgacaatcgttttaaatttttatttccataggtttttggggaacaggtggtatttggttacatgagtaagttctttaatggtgatttctgagattttggtgcacccatcacccaagcagtatacactgaacccagtttgtagtattttatccctcaccactctctcaccctttcccccgagtccccaaagtccattgtatcattcttatgcctttgcatcttcataggttagcttccaattatgagtgagaacatacgatgtttggttttccattcctgagttacttccgttagaataatagtctccagttccatgcaggttgctgcaaatgccattaatttgttactatttatgactgagtagtgttccatcgtatatatgtataccacattgtctttatccactcgttgattgatgggcatttgggctggttccatatttttgcagttgcgaattgtgctgctataaacatgcgtgtacaagtatctttttcgtataatgacttattttcctctggatgggtacccagtagtggaattgctgggtcaaatggtagttctacttttagttctttaaggaatcttcgcactgttctccataatgattttactagtttacattcccatcagcagcatagaagtgtttccttttcactgcgtccatgccaatatctatttattatttatttttttattgtggccactcttgcaggagtaaggtggtatcacattgtggttttgatttgcatttccctgataattagtgacgttgaccatttttttcacatgtttgttggccatttgtatatcttcttttgagaactgtctatgcatacccttagccctctttttgatgtgattgatttttttttcttgctaatttgtttgagttccttgtaaattctggatattagtcctttgctggacgtatagattgtgaagattttctcccactctctgagttgtctgtttattctgctgactgcttcttttgctatgcagaagctccttagtctaattaagtcccatatatttatctttgtttttgttgcatttgcttttgagttcttgaccatgaagtctttgcctgagacagtgtctaaaatggtttttctgattttatcttctataatttttataggcttaggtcttaaatttaagttcttgatcgatcttgagttggtttttgtgtaagttgagagatgaggatgcaatttcattctcctacatgtggcttgccaattatcccagcaacatttgttgaatagggtgtcctttccccactttatgtttttgtttgctctgtcgaagatcagttggctgtaagtatttgggtttatttctggcttctctattttgttccattagtctatgtgtctatttttctaccagtactatgctgtttcggtgaatatggccttatagtatagtttgaagtcagataatgtgatgcctccagctttgttctttttgcttagtcttggtttggctatgtgagctcttttttgtttctgtatgaattttaggattgttttctctagttcttttattacttctattcaacatagtattggaagtcctagtcagagcaatcagacaagagaaagaaataaagggcatccaaatcgggaaagagaaagtgcaactgtcactgtttgcagatgatatgattatatgcatagaaaactttaaagactcctccaaaaggcccctagaactgataaataaattcagcaaagtttcaggatacaaaattaatgtaagcaaatcagtagttctgctatacaccaacagtgaccaagctgagaatcagatcaataactcaaccccttttacaatagctgcaaaaaaataaattaaaaaaaaactacataggaatatacctaaccaaggaggggaaagccctctacaaggaaaactacaaaacagtgctgaaagaaatcatagacgacacaaacaaatggaaacacattcaatgctcatgggtgggtagaatcaacattgtgaaaatgaccatactgtcaaaagcaatctacaaattcaatgcatttcccgttgacaatcttatcacctcttaaaagctgcttcccaaattcccttctattattttgctattgctcaagttatcaatacgtattgcctttttgcatgttgatgtgcaaatttaacaatttttgaaaaccttcaacaagactagtgagattcagatttgccatctaaatagctccagcatacaaagttctaaaccatttttgacagaaggcctaaataatgatttttatgtcttcaggtcagaaattctaggggagcttggtataacgtgtgactcccagaagaatgtgttatttgtgtctgaaaaattatttttgccttaccctgtgtttgcagtcatcattggtttaagaaccagatggattttgaaaaccaggaaactctgggatgtaagagaagaataaggaaaggcaacatctataagaccctataagttacccagacatctggttggattctttatgcttactgtatcagggcaatgatgccagaaaggaagtgacacagatatttgcaaattatattatttgtaatttttgacacattggttgataagcttctaatatttatagaaaaatctattaaatcttcataaatatttttgtaagatgtattgggtttctaaaagttttctatggatattatcaatcagtgaatattaagttaaaaagaatcagctccagaaacaatccttgggtataatgggaacatcaaacttcttgttagatgatcagctttaatcaaaatatattctttgcatgtggcatttacattttagatcatagggaaattggagttctgacaattggctaacaatttctaatatgttttgtttagataaatttgaccatgtattaaagatcatcctacagagatgtaacagtgtcactttaatattcttatgcctacttcatagtaaggcaaataaaatcttcagaattgttgctggctgcctaaacatgggttactgtttattaatattttctttttcttgtttgttacctttctagaaacttgagattttcatgtgatgctctctttctctttttttgtatgcccttaagtattttgtgtaaagcaattaaaacagtaatttcagtaactagtttatgtcatgtaccaaattcaaaaatgacagctaagaatgaaatttagctctagcaaggaggctttaattaaaggatccttgcatctatttcagtgacttcctgttagtaattcaaccatctcctggttcactatttctgcagtgctctgaaaatgaagcttgtctacttattttttttttgtgtgtttcgtaagaattgaagaagcactcataagaaagggaaagggaaagagggaaagcaaatggacctaggatatcatgccaagtgtgtggggtgttattcaaataaataaatatatatatatatatatatatatatagagagagagagagagagagagagagagagaaggtttataaaacaaaaattgcagaaagtacatttttactatttgtttaaagaagaacccataaaagaagttttctgagataaagttgaaaaatgcacatagaggcaggtggtgccattagccctgctgttgggactgacagatcagtactgaagtggcatcagggtaggaaggtatcagcttcagtaatggagagatgtccaaaggaaagattgctctatcacagtgatgggatcctagcatgttataaatcgaagattgttctttcctgccactgagatgagcagctctttctcctttcgagaatgaaatgttggacacagacaaggaaaagatgaaaacaaaaaagtaggaaaaagttttttctctttaatgtaaatctcccgggagaacagacagtgtagtgccaatctccattttaaacaggaggcgaagaaaatgctcacttttggcaatttcttctcatcttagcatacagaataggtaaattatggtaatagttctatatgtctcttgatataacttggttcttattgttttttaaattggaactattaatagatttacacttttggtttggaatgaaagatatattgagctgggatgagattcggttagaagaaggtgcagtgtgtagtaaaacctgtacaacccagcttttgatttctggccaacttgctcttacatataactaactaggcgatattaggcaagatactttccctctttgagtgtaggtctcctgatcagtgaactgggagatgacatgtaaatagaacctagcacacgaccgtgtttgtagtaagtagttgaaaaatgttattctcttttccttcccagcagtctaagttaacctacgtggccaatatttgtctttttctggaaataagtaaatgggaacaaaataactttttgatgattattttaaaaatattttattgcattaagatgatattagtgaagttctatataaatcatgaagtttgcaaaactgattgcattttaataaacaaaattaaaggaaacacacataattaacacaaaaaatttccaacaaaatatataaattataacatgggcagggttacaactttgttatcattttagccacaggttgattgaagaacctgcccaaacccccacatgaagattattgacaaaggtggaaatgagcaccacatttttctttctttccatctagcactccagctttaggctcataaaatgtgtcactgggcaaactaagcatagggatttttatttttttaaaaaaagaatataacaaaaaacaaaactagtgggaaaaaagcacatcatgtgaagtgaggtacctcttttagggaaacatatagaacatcagtgaagatactaattgatctatatattaattaatcaacatactaatcagaaataaaataccaaattataacttcttgaagagcagcatggtatttctctacatactctattttgaccaaaatagcaaagcatgactttcttctgaagagagacatgccactgatgtccaagatgagaattataataaaagaaaaatattctcacaaaataatgcattgaattaaggaagcagttctcaaactacagtcttgggtactcccagaggcctctaagatgctttcaatggttccataggtccctcctttttcaagtacacatgcgcgtgagactaaattttctccctgtactttaaccaaaacaacatactgcatctgactgaacgtagaagagaattcagttgtcttttgaatttacaaaaaatgtaaaacagtgccattcttgtcactgaatattgtttttgcttgtttgtttttaaaaatagttaccttgtcttaaaatgtattatttatgttaatagataatggttttattattgtatttttaatgaattgataaataagatggaaaacagtcctaagaccaaaacctttgagaactgcctatttaaggtatgagaatttttgtgtttagagattagatctccacctcattttgtgtgtgtgtatattcttcttataaaagtaaaatataagttagaaaacatttgggaatttgtgtaaagtcaaatattaatcccctatattcacataatccaaaggtattgcattacctttcttcatttcctctatgcacacatctacatatttatttaaacaaaattaggatcataagctttacacatttctgcatctttttttcacttaacattgtatgatgaatacttttgtgatttttcaataatcttcagaaatatgctatttaatgactgtgtaatgatcctttatataaaatccttaagcactgtgttggtgggcgtattgattgtatttttaggtgttgttagtatcatcttaatcatcatcacttttgtcatcgtatttaacatttattaggctcttattatgctctaggcaatgtgctaaactctttatgtgccttattgcatgtaacctacttttggggtgtcttgatatttcctctaagaaatggtcttcctctttcttccacttacatcccttcaattatttctgtcattggatctagctgacagatcatatggaaaagggagtgagatatattgaaccaatttctttttttttttggagacaggtgtgatcttggttcactgcagcctccagctcctgggctcaagccatcctcctgcctcagcctcctgagtagttagggccacaggcccatgccaccatgctcgtttaattttttgtgcttttgtagagatggggttttactatatttcccaggctggtctccaactcctggggtcaagagatcctcccacctaggcttgctaaagtgctaggattacaggcgtgagccaccacacctggcctacaactcttgctcttaatatataagaagcaaaggaaaaaaaatgcctgattattgcagtctaattaattctaatgacaataactatataaaaatattgtcattatggttttattttttctgcttttgtttgatatggtcagctaagatgctttctctttcttttctattcaggattcttgggatggtggaatttgctctagttagtttggttagaatcaccacagatatggatacagatcggatagggtctagatagccttaaactcagacaaattctgcctcacagatatgcaatatactaattccagtctgctcctttaagaacacatgtcattggttattaggacaatcaggcaagagaatgtggatagctcactataaaccatccatagggatggttgagtactaatgacattttggcatattggaaaaaaaatatttttcagaataaagaatcgagtattgatttcctcaccatcatacaattctttttaaattttttaaatcagaaagttgttcattttttaagcttggctttgcaggttaggttttttgaaagtattcaggcacattctaaacttcccagatgtgaggaaattgaaagcacacaatgtttactgacatgtaaaactctgggacacagttttcattagttaaatttaaaatcttttcttttcttttttaccctttgtaaatgtgaccagtgaggcagattaaattagctagggaagtcagaggctaagggtcattttgcctctcatctgcacgtgcaatatcaactgaaataagtgattatttttcattacaatcaagattattatctattgtattttcataccatttcctatagtgaaattatgcgttatgctttttaaatctggtatcttaatagaaactcacgttagaaatatagaagctagccgtgagactgtgttcttaaaactaatgatctagattcatgaaaggataggaatacttagtttaatacattttccagtatatatatttatttgccatctttaacttcaaagttgtgttctttgaacaacttgttctttaggaatgaaataatctttcagaaggtacccatgttagtggtgacaagacccattaaatatttaaatagtgttattaggtacatcataaaaatacatgtagaaattgtctattttaaaatatttagccatatgtcaaatataaaatgttactaatgtgctgagttgaggagactttggttaacttttgagtaggtttattgtcatgtaaccttttgggattctttccttttctttaaggagacaaatggatgattgtaacatgaacatttaaaaatgaaatgcttaatggaaacatgaataaatggaaacagatttgcctgtcaaaaattaaatagcaatattctttgattaatatcaaaatctaatctaaaatagttttagccatttcatgcaggtgacatctgtgcttaaatataattttctctccctgttctggcatgactgttaattacttactcaatgtagttcaacatttagttaataaatatgtcaagctttttccttagtgttctttttgcagagttgtgaatttgcaattagttttagatttacaacatggtgacagacagtgctgtataaatagaggttaaacacacaatttacatattaattccatgattcgtttattcaatgatttatggggatatagattgcatttaatgtctgtcctgtagttgtttcaggcatgacaaaaggaatcactatagtagcagagaagtaatggtgtctatattgaactacagggtgttgaggggaaaataagaaagatttggaaacacaatgattcattacctttaatactctccaagtggcaagtgaaaagtaataattgatttttaaaaggattacatctgataattctaagagtaggggaggagataaattaacccgctagcatagtgtcttgcacatagtaggaactaaaatgtttgttcaattgaagtgacttgaagttgaggatcataatatgtttttaagactggataaaacttaagttaaactttgagaagctttaaacaaatcttttttagctgacttctattaattggccttgtttcctcatgacaggtgccgtcatattttaaaaatcctcttatccattatctatgtagatttattagatattcttggccatattgatgcaatgccaaacatagactgcaataaggagattttcttactgcttatttttttttagaaatatcagtatctctgaatgattaaaataggctatgttatgtaatgaaacgaaaacctctcaagtttgtagtggacataggtctgctttcaagatatttcaaaaaaatctattcaagataggtaaatgctgtctatactctttttttgcaatatcaaacatatgattaattaacttatggatttaatccataagtttaaaccggataaaacttactagatacagtaatattcctgaagcaacttgtggtcctcaaactgacttcatgttgcccctttaaatgtcaacagcagttattgtggagaatacttaacttagtgctgggagattgaccttattttcttcttgagaagatcatgccctacaattctgatactctcaagaacctcctctatgtaaagatacaaatgtaaaacccactaattctcagcaaggactgtggattactttcacaggtcactgagctgggttctccgaataggtaaagtactttggggacatctttgtattacctatgtactttttcaagccactagagttagcaattactgcaagaagcagaattttttaacttaaattctagtggctggaaatcataccaaaaacccaggaactgtaagtttaatttaataaatctgttcaatatgcgtttgtttaatccctacttaattccaagtccttttacatacttgccaagtccttttacaaaatccaaagatctcatttaatccttatatacccctcaatagggcatgattaaatccatttttgcagatgcaaaatctgagcctctgggaggatacatggcttgctctggagacaattttgtaaggattggaactcagatgggtctggctccaaggagttaccttttctttcacatcatggtgtctcctattaagggatggagttaatgtgtttgcagaggcacctaaagtatcccaaaaagtaaaattggaaggtctaatccaggatgttccatcttaagccttggcaacatttgttcaactcttacttaacgttgcccagtctaaatgatgcttccagtaattttagcaattttaattaagtagacagagttgattacttcaattgcctgcattgccttttgtcagtgattcaaatccagctatttcacatgttcagagctcccaagtgcttcagaaaagttctaggagctaaagagttaaatgactggtgaataaatcttcacaattttcacacttctttactcagtggtgtctcagcatttttcttgaatggagcagtttcttataattttactagaaagattaaaacacgtttgcagtgaaggtagtatgcaaatacatgacatgcgttggatccctgaggtaatctaatgatataatgcagggagatttagtgaaaaataaagtcatagcaccaaaacaattggtagtaaagcaaacagaaaatttcaaagccagttctttggttcttcttcacctgatggctcttatcctttttctctttatcttttccttcttgactccattttctactgccttgtggctttccaaagagtgaggcagggataaaggcttgattttatgtggagacatcttctaaccatttaaaattcacagcaaaaaatgtaatggacttaaaactgccaaaaatgattgactgggagtggaaaatgaagaggaatttctaggaagaaaaatgcttagtggagtacatttcattctggggcccatacttgaaattataaccatccccacttgctgagcacctaataggaactttccaagttgagcaaatagaggtcaataaaataagctccttcccattaataaaagttagcttattatagccttctgcactgtaagctgtcttttcagccaatgattaataccacctagagcttgcatatggagggaaattgaagtagggtgagtgaagtgattattttcaacagtagattacctagaaaaagacaatttaatgaatgaacaggtaggttcatttctggccaaatttcaaatgtggtgtcaaaaataaacacttgaggccaggcacagtggctcataccagtaatcccagcactttgggatgctgaggtgagaggattgcttgaggccaggagttcaaaacaggcctgttcaacatggcaagatcccatctctataaaagaaaaaaaaaaacacacactagctgggcccggtggcatgcctctgtagttccagctcctcgggaggctgaggcagagtattgcttgatcccaggaatctgaggcttccatgagccatgatcctgccactgcactccagcctgggcaatagagggagaccctgtctcaaaacaaaacaaaacaaacaaacaaaaaaataaacacttgaaagctaaggacaggagagggtgctgaaacttacatattcttctcccatatagatccacaaaactgaatcaattgcatttccatttatttaaataatttgcatatatcagcagtgtattcttatcttggtttgtagatgagtttctcttttcttgctggacatagagttaaatctcacttttaaatcccttgaaattgaaatgtgatgagcagatgactatagggagcaggtgtcaaacaatatttaaatgacattttcaacaaaataaatatttgaaccaccctgtcacattggtgatagaataatctgctccaaaaaaaaaaatgccattcattgtataccgcctctgacatttgttcttcaggaattacttacagtttatcttctgagctggagccttttatcagcaaagcagttgaactacagtggaaaaaatggtaattgagtattttatcaaatgcttctaacaaaatggactttgcaacatgtacatgaaaattaaaaccattggttgcagggatgaacaaattggaatgatttattatcagaaatatcaatatgtcactgttcagaaatagaaagaaacaaacaatctcagtctccctccacattaaaacaacccccatcccattcccagacatatgcacccaaagcactcttagttgcagccaaagcagtggaaggtaagtacattttaattctttgtgctagcaaaaccgctaaagaaaaaggagaaaaaagcatcataataatagaccagctgctgcaggacattatgtaaggaaaagagacagtaataaaagaaccatgtcaaaagaaagcagctatgaatgtatacttcagtgctggtgattgcagaaggaggattaaatataatatatggggcaatttaggaaagtgaatttactgcttatgtttatcacctaagtagccaatgcctttaaaatgggctttatttaacttatgtaacatagctttaaaaaacggcattagaagaatagcattgcaggagtattttatactaattatttaaattttgcatttatttagatttatttagattaaatgcaccatatgtgtgagttcaggttggagacatcaagtagattaacaacaagtagattaacaacatgggtgggagtggatgtgttttttcttgaatttaattgaattttaatgcaattattgttttttcttgaatttaattgaataaattgaatattaaggtttttctttttaaagaaaaaggtcagaaataaaatgtgtaaaagagaaaccctttttgtgacagttcaagctgcttttaaaaatggtgtcttgactttggggatgtcactgaataagaatgtttagcttccttccaggctgccagcaggatgccattgtctgtgctgttcttctctgtgtgaatctaagagtttacttctctcacccatgatcacccatgactattcactaagtacaaatcaaatgggcttacatcaggtagaaacccagactgggaccttttttaaggcatgcagaaaacaattaggtatacctctttaagactggataaagagaactttattttcttccctcatttccctaaaacttccatctcctttagatcttttggatataaaattcaagaggcaattgattgttagttacatgccaagcttagtataattttataaagcagtcataggtagttgaataatatttttaaaaacctaaggaatcttcttctacattgctttttagctacatgaaaagaaaatgattttctgtatataatttatgtatagtgtatgcttaaaatatttctctgaattagttattgcaagcaacttgcaaaactggattcatctagagggttgagcaaaactagcaaatttgtaggaaaaaaaggtaaaatcaaattactaacttgcacttgggagagaacattctgaattaatgaaaagtttgacaggatattttttaaagttataatttttcatgtacatttagtagcttgaattgctcttttctggcggctgtcagagactattttaatgaacacatatttgcatacacttattgtgcgaaagtttttaagtagccttttctctcagctaagccagctcaattaccagtttatttacatgtttaataatttttgcaaactcatttttattagatagtataaagatattcaaaatttgtatctgtgaaactgtagggttgtatcctttatactaaaagcctgatatctttactagttctgcccaatccaggttaaatgggtagttcaatctcatgaccttttaaaaacctaaagatgttacgaaactgttgtcttacaattgaaccaacactgttacttactacatgtgtctgtttgtgtgaaaaggcaaaatctttcccaatacttctatttttgtattataaatagtattattgaaagagaggcctggtcgtgttatgaaagaactgatgggcttaggctcctttttcacagctcatggcactatgctatatagacttgcccctcactgtgaaggccaatcaattgatttcttttagattcaagaaaaataattcccaagttctcaggtctctgtgggaaacatcctttatcatttttgctgaagtacaaacctaggggtaggagaaccagaggactgtaattaacatctccagtcctaaagatgcatgggtagttgggaggggttcgtaatctccgtggccattagattcaaagccatcttaaaaggtctaaccataagctcagcattgaaatatacagaaaatcagtgcatactatgaagagtggatatggcagttccttgtacttctatggtttaatagaagctgttctttttataaatgaatacatatcgttgatattattgcgggacagatgagtggcaaaacaagattctcccagtcttcctagagtgtaagtgatcttctcttaaggaaacatatttatttacttccaatagtacacattatattatattcctaaaagaccaatgtcaccctttgtattctaaaaggcttgttaccacttttttttcccctttcagtgctgaccaattcttacagagcacaggtaaagggtgaaagttttaaaaaacagaaaacattatttatttttattctttagtgattagcttttctttttcatttctcctcgaatcatagtcccagaaactttatattttagtttttcaggaagtactatttgaataaaggaaatctggtgggcatacattatctttgaataaacattttgaatatttgcacatactataaaatcagagaatactaattgtgcctctctatttcttcttgcatcttgtgaaagagttggtgcctgttaaagcatattccacagattctgagatcacaggaaaaaagagatatattttattgtcttaaggtgaaacttttgtggaggagagatttcttcaaaaagggaggcaagggtggtgattagaatggacacgtgcctgggagatggcagagctatctataaaatacacataaataacatcacatctgtttatgtgtattatgtagacagtattattagttataggtatgatcatgttatttatgtgtgtaatgtagataatacgtatgtgcatgtgtgtatgtgtgtgtgtatgtgtatatatgatttgtgtctttaggagtaggtgaaaaggctacttttttactctgcatgtaaaactgaagggatttcaaccaacaaaatgaacttgttcataactagaacttgaatttagagaaaaaacagtggttttcaacctttatcatgcctcagaatcccctcaagggtttgttaaaacacagattgctgggccccaccccctaagtttctgatttgctaggtgtgggataggactgagactttggatttctaacaagttcccaggtgatgtccatgctgcttgtccagagaccacacagagaaacactgttttagaatcaatctattatatttcactttcatattcaatttacctgaactgtgctggaaacacgggtgtcatacaaccgtagtcaacaaaatgatttaaaacaataagtccctgagctttagtttccttatctgtagaatgaagaaattagacttgcataattttgaaggccactgcaaaactgacgttctaaaaacattataagatagtggcaactgatactgtcaaagtatatagttttgtctattccgtgtcttcatgcaaagtttcatgcaacatattgcatgcaaatttgtagcttgatttggaggcagcataatctaatagttaatagtgtgggttcttgaaccagactgcccggttttgagtattacctttgcaattgactatgattgtgactttgggcatgttacttaacttctctggacctcagttttcttaacatgttatatggtcccttccttgtggagttatgaaaaataagttgtactacacattagaagtgtataaaacatgttactgctccatagcagtgccatgtaactatcagttactatttgttaattatgtacatttatcttttttaaatgtttttatagaatattgaactgttgtctttgatagttaatatatattatggataaaaaataattcagatggtctgaaatcatcatactgatgcatgtcagaatacttttgaaattatattttctcaatgtttgaagccagatttaaatcaatttaatcaaattatttgattatctttaaattgacaaatgatcatgagtttacaccaatgactagctatgctgttgatttgtaatagttgaaatgaatatgtcatcattactgtggatgaagtcttctgtgtacagatgtacacgtatgcaattatctgaatatttaatatccaaatgttaagaaatattccttaagtgctagaaaatagagatcagtgagcataaccttatttattggaagctcctatattgagacaaatgttcatatagaaatctgtgaatataacaatctatataaatatgaataagcatttgaggatggtcttgattatttaaatatatattttgtgtttatggaattttatgtttgggagattttacacacaaaatctgaaaattcaaaatctggaaatttcaaaagctattgatttgtcctgaactttttcattcatgttatctttagtttcttgaaaatcagtacttagtataaacactaatgatttaaatgtctctcaaagatggatttgtaggtctttgcatgggccagcaggctgtgtgtctttggtcagttcatttaatcttttagagccctcagttccctcatttgtaaaacgatgtggtcagcatcaatggttttaagttccctcttagccataatattctatgattcttatactattaatactgtaggaaagtaatcacagtaatgtgacaaatagaaattattcatgcttcattgtctgcatgttttaaaatcattcctggcttaggcttagtgtccccccaccccatttgctgatattaaatgttatagttccattctatagacctaaatctcactatacattggctgcatgggtaatatagataaaagaacttctccttacataaatggcataaacatcagtctgcctagctaaattctgacatcaaaaaattctgacaccaaaaattctgacactatgtgctaattgttttatgtctatgtgtttgtaattgggagaacagcagtagatgagaaaaattgtcaggaaagaaaaaagatcactagaaaacctaagcaaaaaatttctttcaagaagtttagtgatttcaactttgcgtgtgaaaagagctgggttaaattcattttattatgtgccaaagggccataatataacaggcttccttcattgtttaattcatataatgaaaaaataagagactcaaattccttgtgttctttgagaaaaagtaatcatagtaaataatagttaacgttcattgagtgcttactatgtgccaggaactcttctaactgctttgtacatattaactcatttaagcctcacaacaaattttgagctaggcactaccatcatctccatttttcagatgaagcacaaaaaagcaaagcaatttaaccaatgccacatgggaaatcaaaagtgaatcttttcaaaaatttttttcattcatttaaaacatttattttattttattttattttattttattttattttattttattttattttattttatttgagatggagtcttgctctctcacctaggctggagtgcagtggtgagatctcagctcacggcaatccctgcctccagggtgcaagcgattctcgtgcctcactctcccgagtagctgggattacaggaggcaccaccacgcccagctaatttttgtatttttagtagagacagggtttcgccatgttggccaggctggtctcaaactcctgacctcaagcgatctgcttgcctagacctcccaaagtggtgggattacaagtgtgactcaccgagcctggacaatttattttaatttttgtggttacatagtaggtgtatatatttatggggtacatgagatgttttgatacaggcatgcgatctataataatcacatcttataaaatggagtatccatcccctcaagaatttatcctttgtgttacagtccagttaccctctttcagttattttaaaatgtacaattaagttactattgactatagtcaccctgttgtgctatcaaatactagatgttattcattctttctaactatttttttgtacctatgaaacatccctatctacccctccccaccccccaactacccttctcagcctctggtaaccagcatactctctatgttcatgagatcaattgttttgatttttaaatcccacaactaagttagaacatgtgatgtttgcaatgtttatctttctgtgcctggcttatttcatttagcatagtgacctccagtattatcccgtgttgttgcaaatgacagaatctctttatttttttgtggctggatagaactcctttgtgtatatgtaccacattttcgaactttctaagaacctgttgatgacaactttgaggacttactctataaatgttgctgaaagcgctttggcctactaacatatttggcttgagcttttaacagctaaattctacacaccacataaagggacagtccactggcacatattttagtgactcagacagaagtataacaatttttaaaagtgcaagatctgataatacaggtaatcaaatttcacacttaacagaatatgctgttctttaagggcagggaggaaattttctgaagaagagatatacagaactcaacaattgactaggtacattatttaccaaaggcaggactgaaatttagaagtatactacaatgaaacaaatattacatagaaatgacatgttagaacctatttttggtctctaatgaggttctttgagatttgtcattttgtgttaaaaagtactctgaggcttttagggctttgctgtttggttttatatattcactattattgtcaacaaggataacatttttcagctaataagatgagtggttcaaagtataaggctttcagaaaagtgaatataaaacaattcttcacccactcctcaaagcaggaaacaaactaagataagattcatgttttaattatatatatatatattatatatatatatatattttttttttttcctaaagagtttaccaccttttacatgtattttgtcattcagatgattcttccactgggttggcttggcttgggggtggggatacatgcagattgtagaaatccacatttccaaatggatgtgttttggtcagagtaaagttgagtgacctgccgagctttgaagatggatatcagaacctagttcttctgattcccaatcaaatactctgttctttagactttgacacaaaatatggctttgaatgctaatgcctttgtttctacactgatattgaatatagaaaagagacaacacatagattgctttttgagactatagcaggggacttctgagaatggaacaagtggaagggaaaataagacaatggccatcaagtacatttctccacatacacacttgtgaatagctcactctctacaaaagacctacgagtcaagtgtagtatttcagcacctctagaagtcacttggattaaaagatatggttagatagaggtgggattcgtttcatgccagaatttttaaaagctttatgaggttaattcctcaatagtcattgatttcgatgcttcaaagccacaagcaggttatcaaaaccttccaccctttatattttctacatattttagaaaattctcttttaacttatttataattgctcttgccaaatacattgttatatttggataatggaaagacagggtgtagacttaactgcatgtaaaatattgtgtctccatctggtttcatagtatacagattgcatctgtgtttcactttattatgtgagtgaatgcagatattcttttctggctacttgtgggtccccaatagagggagaaatcacttctttttaaaagaaataaaaataaattaatatttagataaacatctgtaatatctttcatttgaatcaatcagttaattaactgtatcttcgttgtcgactatgtggccaccctataatagatattgggaaatttctaagaaatataagacattttggcacttacagaactcatagtcttttgtaagaatgaagatgtacaaaaaattagagtacacagcaaccctataacaaataagtgccaaataatgtattatagagaacaagtgctacaggaagtcagagaagagattgataaaagagaggaccatcaaggctcttcaagaattagcttgtttgactctctgacaatgttagtgctgttgtttcagccttatagggcagtccctaagtgttccctgcttaaatttctatttgtaatatttcaaggcaaattcaaattccatcttttccatgaatccacatagttaatttgatttttccttttctgtacacagaatattataatgcaatatttctataatatatttgcctttagtttctgtcacagtactttgctcatagcagaatttcaatgaatgctatattcaatggaactattaaagattagaaatgtaaagaatctgagacgtgaaagatgagtaggaattggttgagcagggagaagtaaggaacatagccatgggggtgcaaatgaatttggtgacggtagaagcagtaagaacactatgttccaaaatgtacattttgatttgggtgtaataaaatcatttttaaattttccattctactcccagaaccaagacattttaatgcaagagctaaaatatgttaccttaaattttatcatgcccttgttaaaatagttttataaaaaggatcagtgtatttccaactttccttcctcaaataatgcctactacactaaatgtactttttgatttgtacaaatttgtggggtacaagtgcaattttgttatatgcatagattgtgtagtggtgaagtgagggcatttagggtatccatcaccttaataatgtacactgtacccattaagtaatttctcatccctcactccctgcccagctccccatgcttctcagtctccagtgtttattattccacactttgtgaccatgtttacacattatttagctctcacttatgtgagaacatgtggtatttgactttctgtttttgagttgtttcacttaagataatggcctccagttccatccatgttgctgcgaaacatatgatttcattctttttaatggctgaatagtattcctttgagagtgtgtgtgtgtgtgtgtgtgtgtgtgtatatcacattttctttaattacttgttgatggatgcttaggtttatttcatacctttgctattgtgaatagtgctgtaaatatactattttaacagagggaattttgagaaaaattagaacaatgtcaagatgacaaaatttaacttggattcagagagaactaaagggtagcagtgcctcacactccctgcaagtagctagagtttacaggtaagacaacagcagcaacagcagcagcaacaacaatgagaaaaatagctttgtataaaaaccagccatgaagaaaacatcttcgtgtgagcattactaagataattttagattggagtagattggacacctgatgaaaggaatagagagatctctagttctttccgatgcaaagtaaaaatttcaaaactagtaacattgaggagggactaagtttacattgctattgatttgaattgtatggatgagtttagaagtcagctcaagtgaggtgttctatgtcagagaaaacaagtccctataaaggtttacttgatgattccatataataagattagttgaaaattgttttttaatgaagaaaatctttctgtagcattttaaatactatcagatctctcaatgcgataacgtagcttttaatcaacataccagcaaatcagtggctttcttggtttatgttgtatctgttgactgcattgtagttatgtttttgggaggaaggagatctagagatttttaatgctaataggcccaccaaagagatttcccttcttcccaagttgtttccttcctttgtaagaaagatgacaaccaaatgggagacatgcaaatgaccccatgccactcaatagacaaaccaattatatgataatagttttataaatgcattcatgtttctatttccattcatagacctttttgtagttccccagttttctatatgtacatttcagaagaacaaaattgtaaaaataaaacattatgtatttttttaccatgaataattagatatttgttcccagaagtccttatttaacgttcaattagctctatacatcaatttcctatttgtttattttaaaatgagcctttttcctatgaaatctcacactgtatttgaataggatgtccagccagttttcttaggatttgcatgacttgctggttgttaattatactttaattgaatctttctaacctctgtttagcacacttgcattgttacatatttagtaatgccttacttagtcttctgaaagagtacatatatcccactggttcctaacaagaatgcggactatgactatttggtgtgaaaaaagtttcctttcaagcaaatattccatcagacaaaatgaaaaattattaaaaagagtttcagcatacaccatctacattttttccagatatacaaaagtgtgttttggtataaatgtagtcaatatgggatatgatgatttttgagagatctatagtattatggttttgtggggaataaaaatcattcacctgaaaacaagccaggctcttgatactagtaacttttcagaaaataaaaaatactttgcttttccaaattttatcattctggtctagtgggattacaccccaattcacatttaagagcaaaccagtggatcacagaaataatatgcttgttcctttagaatttatttgaacgttcagagtatttcttttgatctttacagaatgtgcattttagatgtagatatcctatttaggtatttttatatttttcctttaggaaacattatttgcatgcattctgtgctagaagtttcaaggtcagcatttcttgcacagttgtaatagtcccaacagaaagataaatatatattgactgaggctggagttctagttctttcagttgctgaaggtcaacagccccttagagataactctccaaccttcaaatatctgtaggttaaattactggtaaatcactgcacctttctaaatggaggaaaccgacattgtactgggaagcagaactatgtattgtgtgttttgactgttgtaattttgaacaagataggaagcaatttcaatccaggcatggttccaaaactttatggaaatgattgcaaaactgaccactcaggctgaatattactaggcaaaaagatttaggggcatcatttctttggcagatttaagttgtaacattgtcataggatttatttagaatgagctaataacattaaatcctttttttttttttcttttttttttgagacggagtctttctgtttttttttttttttttttttgagacggatctcgctctgtcgcccaggctggagagcagtggcgtgatctcggctcactgcaagctccgcctcccgggttcacgccattctcccgcctcagcctctcgagtagctgggactacaggtgcctgccaccacgcccggttaattttgtttttgtatttttagtagagacggggtttcaccgtgttagccaggatggtctcgatctgctgacctcgtgatctgcccacctcggcctcccaaagtgctgagattacaggcatgagccaccgcgccctgccaacattaaattctaaagcatgttaacatttaaattatttaggtactgaaggcatgtttgatacagttgggagtgttggaggaagaattactaaaaacagtaaatgacaacaaaaaagatcacgataaagtcatcttcaatgaatacaaaaggatttgaagcttgaggaaatcgtcatatggcccagagtattgaaagcagcacagcaaaacatagtgaaagtaaatgagacacttgacttttgcacatttctactggcatattttagagaatatgatccctgcaagccagggttgagagaactaaatgaactaaataggcagaatgaaggagaatgtattgcaacagctgcttaatttttttctcctgttttacatataacgaagcaatatactacaaggggtttatgccacaaactttattatataacttaaaacttctttttaattcagtaaaatttacattacagaaagttaattccataactatgttcagatatttttctttcaaaaatgaattcatgtacagggaattacattttaattattgtttgatactaatttagaatcatttaaattgaaattttgtttttttaacctttaaagtttttcattttaatttttgtgggtacatagtaggtgtatatatttatgaggtacattagatgttttgatccaagcatacaatgtgaaataagcacatcaaggagaatgaggtgtccatcccctcaagcacttaatatttcagttacaaacaattgaatcactctctttaagttatttaaataagtacagttaatttattattgactctagccaccctgttgtgctatcaaatagaaggtcttattcattctttctatattttctgtacccattaactgtccccacctcccccttactctcccactactcttcctggcatctggaaaccatccttctactctctgtattcatgagttcaattgtttttatttttagatcccacaaataagtgagaacatgtgatgtttgtctttctgtgcctggcttatttcacttaacataatgatctccagttttacccatgttgttgcaaatgacaggatctctcattcgtttttattgctgaatactattccattatgtatatgtaccacattttctttattcattcatctcttgatagacacttaggttgattccgaaaattagctattgtaaacagtgctgcaacaaacacaggagtgcatgtatctcttcgatatactgaatttcctttcttttgggtatatacccagcagtgagattgctggatcatatgatatcttaaactgttctccacagtggttgtactaatttacattcccaccaacagtgtacaagggttccttttcctccacatcctcgccagcctttgttattgcctgtcttttggatataagccatttgaactagggtgagatgatagatcattgtagttttgatttgcatttgtctaatgatcagtgatgctgatcaccttttcatgtacctgtttgccacttggatgtcttcttttgagaaatggctattcaaatactttgcccatttttgatcagattattaaaatttttctatagagttgtttgagctccttatatattcttcttattaattccttgttagatgggtggtttacaaatattttctctcattctgtgagtagtgttttcattttgttgattgtattctttgctgtgtggaagctttttaactggctgtgatcccatttgttcatttttgctttggttgcctgtgcttgtggggtactgctcaagaagtttttgcccagaccaatgtcctggagattttccccaatgttttcttgtagtattttcatattttgaggacttagatttatctttaatcatttcgatttcatttttgtatatggcaagagatagagatctggtttcattcttctgcatgtggaattccaattttcccagcactctttactgaagagactgccttttctccagcgtatgttgttggtacctttatcaaagatgagttaattataggtgtgtggatttgtttctggcttctctattctgtttcattggcctatgtgtctgtttttatgccagtaccatgctgttttggttcctatagctttgtagtataaaatttgtagttgggtaatgagattccttcagttttgttctttttgcttagaataggttgggctgttctgggtcttttgtagttccaaataaactttaggattttttttctatttctgtgaagaatgtcatcagtattttgatagggatagcactgattctgtagattgctttgggtagtatggatattttaacaatattgattcttctaatttatatccatggaatgtcttcattttttgatgtcttctttaatttcttttatcagtcttttatagtttttattatagagattttttacttttttgattaatttctaggtatttaattttatttgtggctattgtaaacagatgacttttttgatttctttttcagattgttcactgttggcatatactcagttggtgcaaacgtaattatggtttttgcattgttggaatttgccatttgatattggaatacattcttaaataaatgtggttatgttatacatcattttaatgggcatttcttgctttattttttttgctaatgacttattacttgctgtttattttaagtttattttagactatggaaatgatgttagacaaaaaacaaattcaagcgattttcttattccagttaaaaatgggttgtaaggcagcagagacaactcgcaacatcaacaacgcatttggcctaggaactgctaacaaacatacagtgcagtggtggttcaagaagttttgcaaaggagacgagtcttgaagatgaggagcatagtggccagccattggaagttgacaacaaccaattgagagcaatcattgaagccagtccttttacaactacacaagaagctgtggaagaactcaacgtccaccattctatagtcgtttggcatttgaagcaaattggaaaggtgaaacagccaataagtgggtgcctcatgaactgagcaaaaataaaaaaaaattgtcattttgaaatgttgtcttctcctattctatgcaacaacaatggaccatttctcaatcggattgtgatgtgcgacgaaaagtggattttagacaacaactggagacagccagctcagtggttagaccgagaagatgctccaaagcacttcccaaagccaaacttgcacccaaaaaaggtcatatggttactctttggtggtctgctgccagtctgattcactacagctttctgaatactggtgaaaccattatatctgagaagtatgctcagcaaatcgatgagatgaactgaaaacttcaatgcctgcagccatcattagtcaacagaaagggcccaactcttctccatgacaactcccgagtacacatcgcataaccaatgcttcaaaagttggaccaattgggctacgaagttttgcctcatctgccatgtttatctgacctctcaccaactgactaccacttcttcaagcatcttgaccactttttgcggggcaaatgcatccacaaccagcaggatgcagaaagtgctttccaagaatttgttgaatcctgaagcatggattcttatgctacaggaaaaaacaaacttctcattggcaaaaatgtgttgattgtaatggttcctattttgattaataaagatgtgtttgagcctagctaaaatgatttaaaaattcactgtgcaaaaccacaattactttcataccaatctaatagaaatgctactgacttttggagtttcttttataccccagtgacacctggaatgtcagcgagacagaactgttcattcccctggaaaaggggatgaagccagggagccaagtggtctaactcagtggatcccacccccatggagcccagcaagctaagatccactggcttgaaattctcgctgccagcacagcagtctgaaatcgacctgggatgctcgaatttggtggggagaggggcgtccgcaattactgagtcttgagtaggcagttttcccctcacagtgtaaacaaagcctccagaaagtttgaagtgggcggagcacaccacagttcagcaaagctgctatagccagactgcctctctagattcctcctctacgggcagggcatctttaaaataaaggcatcagctccagtcaggggcttatagataaaactcccatctccctgggacagagcacctgggggaaggggtggctgtgggtgcagcttcagcagacttaagcattcctgcctgctggctctgaagagagcagccgatgtcccagcacagtgcttgaactctactaaaggacagactgcctcctcaagtaggtccctgacccctgtgcctcctgacagggagacacctcccagcagggggcacagacacctcatacaggagagctctggctggcatctggcaggtgcccctctgggatgaagcttccagaggaaggaacaggcagaaatctgctgttctgcagccaccactggtaatacccaggcaaagagggtctggagaggacctccagcagacctgcagcagaggggcctgactgttagaaggaaaactaacaaacagaaaggaatagcattaacatcgacgcaaaggacgtccacacagaaaccccaacatcaaagaccaaaggtagataaatccacaaagatgaggtacaagcagcacaaaaaggctgaaaattccaaaaaccagaaagcctttctcctacaaaggatcacaactccttcccagcaagggaacaaaactggacagataatgagttttatgaactgacagaagtaggcttcagaagataggtaataacaaactcctctgagctaaaggagcatgttctaacccaatgcaaggaagctaagaaccttgaaaaaggttagacaaatttctaactagaataaacagtttggagaagaacataaatgacctgatggagctgaaaaacacaccatgagaactttgtgaagcatacacaagtatcaatagctgaattgatcaagcagaagaaaggatatcagagattgaagatcaactggaaatatggaagtatttgaaaagaccaaacctacgttttactggtgtacctgaaagtgatggggaaaatggaaacaagctggaaaacactcttcaggatattatccaggagaacttccccaatctagaaagataggccaacattcaagttcaggaaatagagagaacaccacaaagatactcctcgagaagagcaaccccaagacacataattgtcagattcaccaaggttgaagtgaaggaagaaatgttaagggcagccagagagaaaggtcaggttacccacaaagggaagcccatcagactaacagtggatctctctgcagaaaccctgcaagccagaagagagtgggtgccaatattcaacattctttaagaaaataattttcaacccagagtttcatatctacccgaactaagcttcataagcaaaggagaaataaaatcctttccagacaagcaaatgctaagagattttatcaccaccagacctgctttacaagagctcctgaaggaagcactaaacatggaaaggagaaactggtactagtcactgcaaaaacataccaaatgggaaagaccatcgacactatgaagaaactgcatcaactaatgggcaaaaaccaggtagcatcataaggacaggatcaaattcacacattacaatattaactttaaatgtaaatgggctaaatgccccaattaaaagacacagactggcaaattggataaagagtcatgacccattgtggtgctgtattcaggaaacccatcaaacatgcgaagacacacatacactcaaaataaagggatagaggaatatttaccaagcaaatggaaagcacaaatagcagcgtttgcaatcctagtctctgataaaacagactttaaaccaacaaagatcaaaagagacaaagaagggcattacatgatggtaaagggatcaatgcaataagaagagctaactaccctaaatatatatgcaccaaatacaggagcacccagattcataaagcaagttcttagagacctaaaaagagatttacactcccacacaataataatggaagactttaaaaccccactgtcaatattagacagatcaatgagacaaaattagcaaggatattcaggccttgaactcagctctggaccaagaaaacctaacagatatctacagaactctccaccccaaatcaacagaatatacattcttctcagcaccacatcacacttattctaaaattgaacacatacacaaacacacaaaatttcaggccaatatccctgatgaacatcagtgcgaaaattctcaataaaatactggcaaaccaaatccagcagcgcattaaaaagcttatccaccacgatcaagttggcgtcatccctcggatgcaaggctggttaaacatacacaaattaataaatgtaatccatcacacgaacagaaccagtgacaaaaaccacatgattatctcagtagatgcagaaaaggccttcaataaaattcaacaccccgtcatgctaaacactctcaatcaactaggtattgatggaacatatctcaaaataatgagaactatttatgacaaacccacagccagtatcgtactgaatgggcaaaagctggaatccttccctttgaaaactggcacaagacaaggatatcctctctcaccacttctattcaacataatattggaagatccggccagggcaatcaggcaagagaaagaaataaagggtattcaaataggaagagaggaagtcaaattggctctgtttgtagatgacatgattgtgtatttagaaaaccccatcgtctcagcccaaaatctctttaagctgataagcaacttcagcaaagtctcaggatacaaaatcaatgtgcaaaaagcacaggcattcctatacaccaataatagagaaacagagaaccaaatcatgagtgaactcccattcacagttgctacaaagatcataaaattcctgggaataaaatttactagggatgtgaaggacctcttcaaagaaaactccaaccacttctcaataaaataagacaggacacaaacaaatggaaaaacattctatgctcaggtataggaagaatgaatatcgtgaaaatagccttactggccaaagtaatttatagattcaatgctatccccatcaagctaccattgcctttcttcaaagaattagaaaaatttactttaaatttcgtatggaaccaaaaaaaagagctcatatagccaagacaatcctaagccaaaagaacaaagctggaggcatcacgctacctgacttcaaactatactacaaggctacagtaaccaaaacagcatggtactggtaccaaaacagatatgtagatgaatggaacagaacacaggcctcagaattaatgccacacatctacaaccatctgatctttgacaaacctgacaaaaacaagcaatggggaaaggattctctatttaataaatggtgttgggaaaactggctagccatatacagaaaaaggaaactggtccccttccttacaccttatataaaaattaacttaaaatggattaaagacctaaaaccataaaaactctagaaggaaacataggctataccattcaggacataggcatggacaaagacttcatgattaaaacaccaaaagcccttagagtgaacaggcaacctacagaatgggagaaaaattttttcagtctattcatatgacaaagggctaatatccagaatctgcaaagaacttaaacaaatttacaagaaacaaacaaacaaccccatgaaaaattgggcaaatgctatgaacagacacttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccgctttagccgggatggtctcgatctcctgacctcgtgatccgcccgcctcggcctcccaaagtgctgggattacaggcgtgagccaccgcgcccggcccgacacttcttaaaagaagacatttatgtagctaacaaacatatgaggaaaagctcttcatcactggtcattagagaaatgcaaatcaaaaccacaatgaaataccatctcatgccatttagaatagcaatcattaaaaagttcaggaaactactgatgctggagaggatgtggagaaatagggacacttttacactgttggttggagtttaaattaattcaaccattgtggaagacagtgtggcaattcctcaaggatctagaactagaaataccattgatccagcaatcccattactgggtatatacccagtggattataaatcattccacataaagacaaatgcacatgtatgtttattgcagcactgttcacaatagcaaagactcagaaccaacccaaatgccaatctataatagaatggatacagaaaatgtgacacatatacactatggaatactatgcagctgtaaaaaaggatgagttaatgtcctttgcagggagatggatgaagctggaaactatcattctcagcaaactaacacaggaacagaaaaccaaacaccacgttctcactcataaatggggtttgaacaatgagaacacatggacacagggaggggaacatcacacactggggcctgttgggggtggggggactgggtgggggatagcattaggagaaatacctaatatagatgggttgatgggtgcagcaaaccaccatggcagttgtatacctatgtaacaaacctgcatgttctgcacatgtatcccagaacttaaagtatatacacacacacacacacacacacatacacacacacacacatatatatatatgaaatcctgctgacttttgtgcattgattttgtgtcccacaactttactgaatttatcagttttaatttttttttggtgtattctttaggtttttccaaatataatattataccctctgcaaacaaggataatttgacttcttcctttctaatttggatgccctttatatctttctcttgtctgattgctctagctaaaacgtccagtactacgttaaataacagtgatgaaagtgggcattcttgtcatgttccagatcttaaaggaaaggctttcagtttttccccagtaagtatgatactagcttttagtctgtcatatatggcttatattatgttctttctatccccagatttttagggtatttatcatgaaggggtgttgaattttatcaaatgccttttcagcatcaattgaaatgatcatatggttgttgttcttcattccgttgatatgacttatcacaataattgatttgttgatgttgaaccatcctagtatcccaaggacaaatccacttggtcatgataaatgatcttttacgtttattgttgaattttgtttgctagtattttgttgagaattttcacagcaatattcatcagagttactggcctgtagttttcttttctttctttcttttttttttatttgtctttgtctggttttggaatcagagtagtactggtttcatagaatgagtttggaagcattcttcctcccctatttttcagaattgtttgagtaggattggtattagttcttctttaaatgttttgtagaattcaacaggaagttgttgggttgcaggcttttctttactgggagactgttcagcttcgatctcatttcttccatcttgttactttgatctcatttcggcttcaatctcattacttgttattggtctgctcaggttttgaacttcttcatgattcaatcttggtgggttatatgtgtttaggaagttgtccatttcttctagattttccaatttattggcatgtagttgatcacagtagccactaatgattctttgaatttctcagtattagttgtaatgtctccttttatatttatttacttatatgtatttatttggatcttctctcatttatttaatcttttttatttatttgaatcttctttcttctttgatcagctagtctggcttatggtttgtcaattttaacttttaaaaatatcagccttttgtttcattcgttttttgcattatttttgtttcaatttcatttatttttgttctcatggttatttcttttttgctagtgattttgggtttggtttgctcttgcttttgtagttctttaagatatctcatcagattgtttatttgaagttttacttcatttttgatgtatgcacttatagctgtaaacttttctcttagtactgctattactgtattccatcaatttttgtatgttgtatttttgttattatttgttttaagaaaatttttccatcttaaataattgattgacccactggtgatttagaagcatatggtttaatttgtgtatttatatagtttccaaaattccttttgttattgttttgtttcattgtgttcagagaagatgcgtggtattatttcaatttttgtgaatgttttaagacttgttttatgacctaagatatggtcttttttttacaatgatccacatgctgagtagaggaatgtgcattctgcagcagtaggatgaaatgttctgtaaatatctattatgttcattcggcctataagtgcagattatgtccattcaatatttctttgttgatattctgtctgaaagatctgtccaatgctgaaagtggggtattgaagtctccaattattactgtattggggtctcacctctctttagctttaataatattttctttatacatttcggtgctccagtgttgggtgtatatatatttaaattgtattttcttgctgaattgactcctttatcattacataatgaccttctttgtctcatagttttttttcttgaaatctagtttttctgatataaatgtaggtactcatgctcttttttgtttgccttggatggcatatctttttcctttattttcagtctatatgtgtctttataggtgaagtgtgtttcttgtaggcaacaaatcaatggttcttgttcttccatccattcagccagtctgttttttttttttttttttttttttgagacggatctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttttagtagagacggggtttcaccttgttagccaggttggtctagatctcctgacctcatgatccacccgcctcagcctcccaaagtgctgggattacaggagccagtctgttttgattggagagtttagtctatttacattcattgttattattgttaagtaaggacttactccggccattttgttgtttgatttttggtagtttgtggtattctcctccttcattttttcccttcctgtgttccttttagagaaggtggtttcctctggtgatactgtttagtttcttgctttatatatatattttggaccccttgtatttttttgctttaaggttaacatgggaattgcaaattttattttataaaccattgttttaagctcatgacaacttacactgtttgcgtaaacttgcaaacaaacaaacaagcaaaaaggaaacaacaataactttatgccttagcttcattctccaacttttaaacttttagttgtttctatttaaatcttattttactatgtctgaaaatgtagttgtagttattattttttattcattcattgtttagtgtttctatataaagtaagagcatttacacaccacagttactgtgtcgtaatattctgtgtttttttctgtaattactattaatattaccagtgaggattgtaccttcagatgatttcttattgctcattaattttttgtttctcattgaaagacttcatttagcatgtcacttataataggtctaggtctggtgttgatgatatccctcagcttttgtttgtctgggaaagtctttatttctccttcatgtttcaaggatatttttgccagatatgctattctagggtaaatatatttttttccttcagcattttaaatatgtcctgccactctttactggcctgtgaggtttccattgaaaagtctgctgccagatgtaatggagatccattgtatgttatttgtttcttttcttttgctgcttttactatcttttctttatcttaggcctttgggagtttgattatgaaatgctttgagttagtcttctttgggataaatctacttggtattctataaccttcctgtacatcgatattgatatctttctccaggttttggaaattctctgttattatccctttgaataaactttctaccactacatttttctctgcctgctctttatggccggtaactcttatatttgctcttttgagtctatattctagatcgtgtaggtgtgcttcgttgtttttgtctttttcttttatctcttctgactgtgtatttttaaatagcctgttttcaagctcatgaatttattcttctacttgattgattctacttttaagactctaatgcattcttcagtgtgccaattacattttttagctccagaatttctgcttatttttgattatttctatgttttaattaaatttatctgatagaattctgaattccttctctgcgttatgttgaatttctttgagttttctcaaaacagctattttgaattctctatctaaaaggtcacatatctctgtttttccagtttttgtacctggtgccttatttagttcatttggtgaggtcatgttttcctagagggtcttgatgcttgtatatattcctcagtgtctgggaattgaagtgttaggtattttttgtattcatctcagtctgtgtttgtttgtacctatccttcttgtgatggctttccagatatttgaaaggacttgggtgatgcaatctaagctgtatgtgctttagggagcaccctaagcccagttagctctgtgactcttgcagactcctagaggtattaccttgatggtcttggacaagattgcagagaattctccagatttttaggagagagatttttgttcttctcccttactatctcccaagaaaaggagtctttccctctgttctgagtcagttaaagctagaggtggagtgacaactacctctatggccaccacttctgtgactgcactgggtcagacctgatgccaccacagcactgagtctcacccaaggcctgctgtaacccctccctggttactgcctatgtttgctcaaggtcctggggctctacaatcagcagtagaaaagcctccagacctgtgtccttcccttcagagtggtgagctcccccagacgcctgacataccaagaggtgctgtctgggaggcaggccctagagtcacacaccttagaggtgtaattgtgtattctattgtactgtggctaccctggcactcaaaccacaagacagagtccttttcactcttccctccctttcttaaatgcagaggagcctcacccagtggctaccactaccataggcccacagagaatattgccagactaccactgatatttccttaagacccagggctgttcactcagcttgtgttgaatactctgactttggactcactctacagggcagtgggctcccttcttgcccaaggcaggtacagaaatgctgtactatagccaagtcctggaataagtactctcaagtctggtttggtgctctattatcctgtgacagagctggtacctaaggtagtgagacaaagtctcatttacttttctctctatttttctcaagtggaaggagtcttgccctgtagccaccatagctgggagtgtgttgagtctcacctgaagccagcaagtctcagtgtctcacagcccttgatgtagtatctgggtatcactgctggttattcaggggccaagggcacttcagttagcaggtgatgacttcttccaggtcttggtcattcccttcaaggcagaagtttcccttatggcccaggatgggtccagaaatgttgctcaggaggaaggtcctggaaagggtgcctcatgactgaccagtgccctattctgctgtggctgagctggtattcaagatgcaagacaaagtcctcctcactcttatctctcctctcctcaagcagaaggatggggtatcttttggaactgcgagctgtgcagcctgtggttaggggagggttgatgtaagcattcccttagctgcctcggttggtgtctaagcaggtttcttttatttatttatttatttattattattatactttaagttttagggaacatgtgcataatgtgcaggttagttacatatgtatacatgtgacaagctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttcttcttgcgatagtttactgagaatgatgatttccaatttcctccatgtccctacaaaggacatgaactcatcattttttatggctgcatagtatcccatggtgtatatgtgccacattttcttaatccagtctatcattgttggacatttgggttggttccaagtctttgttattgtgaataatgccacaataaacatacgtgtgcatgtgtctttatagcagcatgatttatggtcctttgggtatatacccagtaattggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatggtgagcattttttcatgtgttttttggctgcataaatgtcttcttttgagaagtgtctgttcatgtcctttgcccaatttttgatggggttgtttgtttttttcttgtaaatttctttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgtttaagacatgaagtccttgcccatgcctatgtcctgaatggtaatgcctaggttttcttctagggtttttatggttttaggtctgacgtttaagtctttaatacatcttgaattgatttttgtatcaggtgtaaggaagggatccagtttcagctttctgcatatggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccacatgaactttaaagtagtttatttccaattctgtgaagaaagtcattggtagcttgatggggatggtattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtatgttggattcctaggtattttattctctttgaagcaattgtgaatgagagttcactcatgatttggctgtctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgatttcctcttttcctgattgaataccctttatttccttctcctgcctaattggcctggccagaacttccaacactatattgaataggagtggtgagagagggcatccctgtcttgtgccagttttcaaagggaatgcttccagtttttgcccattcagtatgatattgtctgtgggtttgtcatagatagctcttattattttgagatacatcccatcaatacctaatttattgagagtgtttagcatgaagggttgttaaattttgtcaaaggccttttctgcatctattgagataatcatgtggtttttgtctttggttctgtttatatgctggattacatttattgattttcgcatattgaaccagccttgcatcccagggatgaagcccacttgatcatggtggataagctttttgatgtgctgctggattcagtttgccagtattttattgaggatttttgcatcaatgttcatgaaggatattggtctaaaattctcttttttggttgtgtctctgcccagctttggtatcaggatgatgctggcctcataaaatgagttagggaggattccctctttttctattgattggaatagtttcagaaggaatggtatgagttcctgcttgtacctctggtagaattcggctgtgaatccatctggtcctggactatttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgttgatttgattcttctctctctttttctttattagtcttactagcggtctatcaattttgttgatccattcaaaaaaccagctcctggattcattaattttttgaagggttttttgtgtctctatttccttcagttctgctctgattttagttatttcttgccttctgctagcttttgaatgtgtttgctcttgcttttctatttcctttaattgtgatgttaggttgtcaattttggatctttcctgttttctcttgtgggcatttagtgctataaatttccctctacacactgctttgaatgcgtcccagagattctggtatgttgtgtctttgttctcattggtttcaaagaacatctttatttctgccttcatttcgttatgtactcagtagtcattcaggagcaggttgttctgtttccatgtagttgagcggttttgagtgagtttcttaatcctgggttctagtttgattgcactgtagtctgagagatagtttgttataatttctattcttttacatttgctgaggagagctttacttccaagtatgtggtcaattttggaataggtgtggtgtggtgctgaagaaaatgtatattctgttgatttggggtggagagttctgtagatgtctattaggtccgcttggtgaagagctgagtttaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagcttttcttgttgaattgatccctttaccattatgtaatggccttctttgtctcttttgatctttgttgatttaaagtctgttgtatcagagactaggattgcaaccctgcctttttttttgttttccatttgcttggtagatcctcctccatccttttattttgagcctatgtgtctctctgcacgtgagatgggtttcctgaatacagcacactgatgggtcttgactatccaatttgccagtcaatgccttttaattggagcatttagtccatttacatttaaagttaatattgttatgtgtgaatttgatcctgtcattatgatgttagctggttattttgcttgttagttgatgcagtttcttcctagtctcgatggtctttacattttggcatgatttggcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctggcttgaaaattcttttctttaagaatgttgaatattggcccccactctcttctggcttgtagagtttctgccgagagatcagctgttagtctgatgggcttccctttgagggtaaccctatgtttctctctggctgcccttaacattttttccttcatttcaactttggtgaatctgacaattatgtgtcttggaggtgctcttctcgaggagtatctttgtggcattctctgtatttcctgaatctgaatgttagcctgccttgctggattggggaagatctcctggataatatcctgcagagtgttttccaacttggttccattctccccgtcactttcaggtacaccaatcagatgtagatttggtcttttcacatagtcccatatttcttggaggctttgctcgtttctttttattcttttttctctaaacttcccttctcacttcatttcattcatttcatcttccatcactgatacgctttcttccagttgattgcatcggctcctgaggcttctgcattcttcacgtagttctcgagccttggttttcagctccatcagctcctttaagcacttctctgtgttgattattctagttatacattcttctaaatttttttcaaagttttcaacttctttgcctttggtttgaatgtcctcccgtagctcagagtaatttgatcgtctgaagccttcttctctcagcttgtcaaagtcattatccatccagctttgttccgttgctggtgaggaactgcattcctttggaggaggagagtcgctctgctttttagagtttccagtttttctgctctgttttttccccatctttgcggtttttcctacttttggtctttgatgatggtgatgtacagatgggtttttggtgtggatgtcctttctgtttgttagttttccttctaacagacagggccctcatctgcaggtctgttggagtactctgtgtgaggtgtcagtttgcccctgctggggggtgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcctccagcctcactgccgccttgcagtttgatcttagactgctgtgctagcaatcagccagactccgtgggcgtaggaccctccgagccagttgtgggatataatctgatgccccgttttttaagcccatcggaaaagcacagtattcgggtgggagtgacccgattttccaggtgccgtctgtcacccctttctttgactaggaaagggaactccctgaccccttgtgcttcccaagtgaggcaatgcctcgccctgcttcggctcgcgcacggtgcgcgcacccactgacctgcacccactgtcttgcactccctagtgagatgaacccagtacctcagatggaaatgcagaaatcacccgtcttctgcgtcgctcacgctgggagctgtagaccgcagctgttcctattcgctctaagcaggtttcatacccaaccagttcactctctctgggcccagtttaacacttcggcttgctcaggagttgtgatcctcttggtgttgactgtctttcaagtttatttgcggccccagaacactttagcccatggtggtgaggcttgtgggaactcaagtttggaccactaggattgacaattcccctctgactagggctggtttaaatgctctctccttggtcggacatcagctgagtttggtcgggttttgctttttgttgtaagagggcaacactgagtttgatgcctcacaattgctatgatttctgtctcctcagacacagaaatggtctccacaataagcttcaaaagacagaggagccagggggatttgggaggggtggcatcagagaacaagattttttttttgtacttcttcagtgcctctttcagtgattttgaagttataatcaggtactatgagtgctcaccttatttttggttcttatgaagggatgtgtgtgtgtgtatagatagttgttaaattgatatcctttggtggggaaaatgattggtgaaacctattctgccatcttgccttgaacacctaattaaaattttggatgcaataataatttaacttttttaccaaaaattatttgtgaaaattatatatgaaatatcttggccgggcgaggtggctcacgcttgtaatctcagcactttgggaggccgaggcgggcggatcacgaggtcaggagatcgagaccatcctggctaacacggtgaaaccccgtctctactaaaaatacaaaaaaaattagccgggcgtgatggtgggggcctgtagtcccagctactcgggaggctgaggcaggagaatggcgtgaaccctggaggcggagcttgcagtgagccgagattgcgccactgcactcctgcctgggccacagagcgagactccatctcaaaaaaaaaaaaaaaaaaaaaaaaaaaaaagaaatatcttaagttagttcatgacatatttgatataatttgtgacaaatacatcacctcaactatataagtcaactttaatctttattattagagatcccatgttcaagtttgcctataaatgaaagaattattggcagtgtgttttataaatttatattagaggataatcttattttttcattattagaccctctttgttactgtgctttcttttggtttgtctctaaaatgagtaccaatagaatccttttgataacaaatgtattttgagatgtacacatacatatcactttgattaaaaatctttcacaaaaatatttggtaaaatttattacatatatactggagactttacacattttactaggcttattcattttattatggtagaccattcttgagaatccaggttgtggggggcatgtatagattgtgcacaaaacataaaataatacacatgactggtagtatcttgttggtagatagtgaactaagaaacagggatgtagcacatatatagacacacatgtcataacatacacatgcatgcacatatatgcaaacatacgttttctggcttcagagtcatgtatagaaacatatacagtcctataaataaatataattgtgtatatatatatatatatatatatatataattagagcacttaacacaatgaaaaacattacaattgtacacataggaaccattggtctggctactgtataatagggtaagtagctcaattttcagaatattatggggttagagaaaaaatagcttcgaccttcttaggacattcttttgggcattctttccaaaggccaagggacaaacaagaccaaattctcagtccatgggtcacatctagctctcactctaatctgatacaacctccatgactacacagtgatagcgagtacttttctgttttctgctttaaaaaattaatttgtcagttgcagtggtgtgtgagcagctgtctgaacaccgaagcatatagcaaccccatcataggaggttagttgtaataggaatatgtggtcctgtaattatatgattttatgtggaacattttagaagccttccaaatgaaatctcttcctgacaagagtaatgacaaaaagataatttattggaaagcagtcagattgtataaggctgttaaattactctactacaggtgaatcaggggctaagtgtgttaaattggtgatagctgaattgttactgataacgctcaatggtcacaccatattatgttggcttagaaaatgtttcatgctctattcttattgttatcagaagtacaatctctggataaaggataaagtaaaaatatttcctctagtagataattgtagacatttatatatagtcaatgggatattaatagggaaatcgtgtactttattttccaaactggaacacttttgaaagtgaaagtgaccgctattaataattacatcacaacaacaggcataaacaaggaagcaggttcagggaaattgggatgtatagttactctaagaatgacatataaaacttgacaagatagttccacaggtgactcaggcctggccagcagtgaacctccttgccttctgccttctattgaagtgacatttgtataaatgaattggtttccatgttataggtattcatttcataatatgaggatataatgtggttcctgagcgcattgtttgtattggttttgctttagagccctagaaatgtttgaattgtagtagtgtgttgcagcatcattagatggagatggctggtacaatggctgtcatccaaaatgatatatttccataattctcagtagtgatttgaccctcttggtctacctccagtttctgtttccttcttatgatttttgtgggaggctgatttctgatttaagaaaacatgttatattttatttgcttcctcttttaactctatttttctgcacaactgactaatatgaatattgtagttaatagaggcttacaagaaacactcttaattctcttgtttgctctaacgatatctcactgtggcctcttagataaatgaccaagtggttttgttgacatatttatgaagttttataatagaataaactgggtaaagtgcattttatggagcttacttaggtttttagtttaaagacaatatagccacaaggagtagtactatttcaataaaccccaaactaagtcattttcatccacaattctttaattctctgttaaaaatgtcattgtagagatgatctttatacttttgaaaagtacctaattagatcaatcattccaggtatctctgaattatttttacaaaaaaggtttcagagttcaggtccaacttgtaaaatgatggcaaaaattattttagctttgagttgcttggcttattcatatttctttttgtttttctgcaccttttgtatattactagatttaaataattttcataatagtttgaagaaaaccacagtgaagtttaaaatttgttgtgactgtgaaactgtgctgttgaatgataaggacactccaccctgttcattggctaagaggaaatgtaatcaaagtattgtctttgttcagtccatagtcaacttgcattatttcttaatttgtatctttagattctgggatatattgagtttagaaagtttctttttactctgtcaacatctttcttttaaaacaatttctgatttgtacccaaatattttagttgcttcaagctttacttttataaggtacacaaatgttatttgtgaatatacagtatcttttttgaaggagaatacgtaatgttggttgccttttataattaagctactgtggatgaaccttttatgacaaataagagacaattttgttatgactcttatgttacactgtgatgcagttctctctacttttccatgcccccaatgagggggttttcattctacttcagcttccttatatccagtgacatgtgtataatggatcatgttcagcttagcagtgattctgacagtgctcagcacaaagtagatgctcagtacttctttgctggatctatgttagctattgaatttctttttgcatctcataaagatatgtgtgttgagatatgattacttaaggaatattcaggacaatggggagctgttatggttgctttaggctgggtttgttttacctacaatggggaagagagtgactaccacccaaaatttgttttatattctgagaagtctcaggtttatttcataacttgaaaaaaatgtcggtgttcattcaaatgaagaagcaaaaattttcaaataatatgcatccacatagagcttggcttaaaatcagggccatttgtggcatttctccccctttggcctcctccatttgtcagctttttgagaaggtgtatatatttccataaaattcacagttggctgacagtaacaacataaaacttattttagagattatcattgtattttttaaattttttattggtacatgatatttgtacatatttatgggatacatgataacttttgttacatgcatagaatgtgtaatggtcaactagatgggtatccaacatgttgagtgtttagcatttctatgtgttgggaacatttcaagtcctctgtttcagttgttttgaaatatacaatacattgttgttaactatagtcaccctaccctggtatagaacattaggacttattctaactctatgtttgtacccattagccgttaattatataggcatctcaaatagaatatttaatgaagaaccttgaaggaactgaactttacttctttgcgaaaaaaaaaattgcataatagtgcttaagaaaaatgtgtatatttaatttcatactgataaagttgggttttaatgctatttcactttactaatggattttctcattttgtattacttttattttaatcatgagaaagacttgtttttaaaaagtttattttattagtattccagttcttaatttatcgcaaggacaaaaaaccaaacactgcatgttctcactcataggtgggaattgaacaatgagaacgcatggacacaggaaggggaacatcacacaccggggcctgttgtggggtgggggaagggagaggggggagggatagcattaggagatatatctaatgtaaatgatgagttaatgggtgcagcacaccaacatggcacatgtatacatatgtaacaaacctgcacattgtgcacatgtaccctaaaacttaaagtataataataaaaaaatgtttagcccaataaaaataagcaaaaataaaattcaggtgggtcctcttcatttaaatgctcagtggctttatacttgaatacttgactatacaatttatagttatattagtcagggtattgcacatggaaattgtattttgccattttctgtgctcattcagcttcctttgatttaaaaattattaaaatggaataaatatttagcaccagctaagaaaagttttatttcaaactgaagcagtacaaaggttattggccatattgtgaacaatgtagtatgaagtggattcctttagttgttcacttattaaggaaggtaactggaagaagggaaaaagaatacaatgtttgtgttatttgtgacctatattgcccttcaaatactgaagtaacacattggacttaagaatggtaagaggaataaagattataaagcatatacaaaaatccattatttggggctttctcttacatcagtcatggaaaaatttggcatgggagagaaaagtgatggaattatttgtatgagaacatcataaaaatttattagtcaaagttttccagcaagacaatggattgtgcaacagatacatctaatgtagcagaattttctttgttttatcagtgacaaatacaggttcataaatatattactgaagacattttaattttaaagccttgcccttctgcttcagtgataaaaaattatttttgaaattcaaggaagattattcttgaaatataaaaaaaactgccctgtggtcaatgatagtcttaactacctgtcaatcaaaagcagaagtttgttgagacatttaattacaaggtaatgtagtcatcaaaatgtcattgtggtaactgacagctcattttggactgaaagtgtacaactacctcccctgaggtcagagatgtttggaggttaacttagtaatgacaaatcctttattatcacattatgacattgaaaaaatgtaattacactaataaattaataacagtagtaaaatgacagtcataattgcataatgtacaagttgtcaactgcgtttttgatacatggttggaatttttatcttatcagtatatttgcagtatattaattgtcctgaatatggcacagacacagaaggatttctaaaatttttcaaatgctatggtctatacttatgggagtccagtgtatccatactttgattctacttatattcttcccacctctttctcttctgctgttttacaaagccttaaaataaataaggagaatttgcaattaccacttgacccagtgttaatgtgtagttaatgtcctttttatctgggaaagttttgacttctgtctgaagaaaattttggcttaaatgtcttgtacttaatgcatgaagaaaaaaatgaaaggaaaaggacagggttttatacatatatattttattttattttattattttatttcattttaaatagctgtagatgcaatctttgacttcctaactttgcataaatatagaaagtagatctccttagtatctaacttccttctgccttgaaatcttccagttaatataactaggagctggctaataataggtttatgcatgtagtgttctagccgtgagttggcacttgatagttgacatttatttataaagagaactagtggaaaaaatgattagttggctactgttttcattgacctgaattatagagaattaattgtataccttttcaaacatttccatggggtaacagatgaccttttaaaatggtgatttgcccattctttttatatttgcttgcaattctttatttatatcttctcctgagtgcacttagaaacttctgggtgtgctgggaagaaaaggtttgctctttggtacccaagtcagaaagtttacccaagtctctgccaggaccatagatttaataaactgttaaaaggactgatttctttgagagaagtttgaaagtagtatacaatagcttttagattatgtattatttatatatctatatatagcacatatattttatatataataattaggaagcttacattgttttttcctcaaaggaaagaaggaatgctccagagtcaaatatgttttaggggagcctaaagattcttaggaattcattggtaatatggctgtgcagtgttttgcaagtttgaaaagatgataaatgataataataaccaatatgtaatgagtaaattttactatgttctcagcacttattaagaagatagcaatgctaacacaaacaatattcccaaaatgtatgaagaggtactattattatcttcatattgcagatgagaaactgaagcacagagcaggtaagtagcttgcctcaaattatacatctagtatgttgtggaggtgggattcaaacgcagacattgtggccccatagtccatgttcttaaaccactaaggatattggaggaaaacatacataaagagcactgcaccaggaatcaggagacttgaattttagctttactgctactaagtagtccttatggtcttgcacaaggttactctgtggtcccaagtttcctcactcctaaaactggacacgttcatgggtctgtaatctggttttatgagaactctgaaagcagacattctttttgcgttcactttttgaccacagagctttccgtttccatttgttatattggctatagagggtgaggttaaacaaaaagcaatatgggtccaaatgtgaagtagaacatattagtctgagctgtccaaagacagaatagacttatttaaacaaatggtgcatttaccatcaagtggaaatgttcaatcagaggatggatgaccagttagtggggtactgaagagaggactcaagtatcagttgggaagtggggtacaccagatgacttttaatatttctttctacctttggattttatgtttctgcaaatctcatcaatatttcattcattcatttaacaaaagcaatctacctgtaatgatatataagcacatatgtataattatgtgaacatactatatatatatatatctttctgtacccataacctgacttatagagtgaatcttgcaagaatttcatctattaaaaataataaatactattcaaagcgatctacagattcagtgcaattcctagcaatgacattcttcacagaaataaaaaacacaatctgaaaattcgtatggaaccacaaaagactcagaatagtcaaaacaatcttgagtagaacaaagctggaggtatcacactacctgacttcaaaatatactatagttatagtaaccaaaacagcatgccattgacataaaaacagactgataaactactgaaacaaaataaagagcccagataaatccatgcatttacggccaactgatttttgtgccaagaacacacaatgggggaaagaacagctgcttcaataaatggtgctaggaaaactggatatccacatgtagaagaatggaactagacccctctctcttaccctacacaaaaatcacctcggagttgccctggcgacagccttcccctgactactcctctgtctctccagtgaaaaatgggaccctgcttgcccactgctcagaagctgcaagctgtgtactcatgaattttggagcccatttggactttcataatcagtgatggcagtaaaggaatcaactttgagagctactgagttttggttctctcatcaggtgtatttacgttattggcaacattaccatcatgtcatggcttggatgcaaagccaccagaatgcctgtaggaaggctgtggaatcctatttcagtattccatggtcatttcctcctgcagttcttccctgaagagcttacgataaccaggctggatatcctatgtccttctctgaccatcacatggcctggcaggactcctacctccgttctacagatttcagaaggtctggacagcatccacatgacagcagtaggatccaggcatccacaagagaagaccaagcttagcctaaagaggaggagatggagagaaagtcagatggggtggtagaatgcgacctaagcaatatggaagtcacccaggacctctgccagtactttgcagagacccagaggcacagagaagaccaatggtagcagcagcagctggatgcagaatacctggatgactacatgaacgctgaccacgacctgtactacaacatctactggtcagtggagcccctgactaagaggcccagtgagcagcaacagactgagaataaaacatttgtttgggagagtgccaccaagatcgaggccatggaggctgaagtgcagctgagctttgacaagcactgtgacagaaaagcagcccaagtattggctggtcatcaccctgaagttctgagcactgggcacagggacccctgagagtgctttctgacagagtcaccagcctcaccctttttggggggtacacgctctatatctctccttctgtacaattctcatggaaaggagaatttgtagtgaggcacagcatgttcaccaatgtcccagttggcctgtcatgggtgtatgtactatgccagctccttagcggtcagccagatgtgtactgttgacaacatgtgaaattttctcctgatataaaatgataattttgtatatattacactgttttttgatgttgtcaataacagttcaattcattaaagttcttgcctagaaaaaaaaataaactcaaaatggattaaagactcaaatgtaaggctcgaaactatagaactactaaaagaacaagcacaggagaaatgcttcatgatattgttcagggcaaggattttttgggtaagaccccaaattatagactacaaaagcaaaaacagacaagtgggatttcatcaaactaaaatgcttctgcatagcaaaggaaataatagagtgaagagacaacatatagaatgggagagaatatttataaacaatgcgtctgacaaggggtcgatatcaggaatatatataacaaaatcgaacaactcgatagcagaaaaaaaaaacaccctaaataatctgatttaaaaataggcaaaagacctgaatagatatttctcaaaagaagatatacaaatgacacataaccagcaggtatatgacaaaattttcaacatcactcaacatcagggaaatgcaaatcaaaaccacaatgagatgtcatctcacaccagttagaatggctatcgtcaaaaagacaaaacaactaacaaatgctggcaatgatacggttaaaagagaacttttatacactgttggtgggaatgtaaattagtttagtcatatgggaaatactatggaggtttctcaaaaaatgaaaattagaactacatataatttaacaatcctactgctgaatatatatccaaagaaattgaaattaatttgtcaaagagatacctatactcccgtctctattccagcactatttatattagccaagatatgaaatcaacctaaatgtccatcaaaagatgaatagctaaagaaaatgtagtatttataaacaatggaatgttactcagctacaaaaaagaatgaaatcctgttatttgcagcaacatggataaacctggaggacgttatgttaggtaaaatgagccaggcaccaaaggacaaatatcacatcatcttactcatatgtgaaacctaaataagttgatgtctgtgatggttaatactgagtgtcaacttgattggattgagggatacagagtattaatcctgggtgtgtctgtgtaggtgttgcccaaaagagattaacatttgagtcagtgggctggggaaggcaaatccagccttaatctggtgggcaaaatctaatcagcttccaggaaatacaaagcaggcagaaaaacatgaaaaggcaagacgaccctagcctcctagcctacatgtgtctcctgtgctggatgcttccttctttcaaacattggactccaagttcttcaattttgcaacttggactggctctccttgctcctcagcttgcagacagcctattgtgggaccttgtgattatgtaagttaatactcaataaactcatatatatgtcctattagttctgtccctcccagagaaccttgactaataaagattttggtaccagaagtggggtgattctagaggaacataatataaatgatgaagtttttcccttggttttggggtttctgaagttggctgcttaatatgagtagacccaaaaatgctaaggactctacttttaatagcatggagaacaccaatattccttggcatgaactatttagatagttacgcaaaataaatgcatttgacactcctgattcactgctcatgaaaggcaaggagtttagtgactctacacataatatcattggccatatatggagaaccaaggaacataatgaatctggttgttgctccgaagttcagtggaaaaaatgatgaaacaaaatgatgaactcaaggattctgtctcctggcttcagaagcagatactgagcctcaaatctgctaagattgccctgagtgagagtcttatctcctattgagaaagagctgacaatgtagaaaaatagacacaagttcttatcatgaaagtggttgacctgcaatgaaagatgcatggacttccttgccaggtgtctactgttaaagtgagggcatttattggaaaataatggggccctgcaacttggaatggggatgtgtgagaagaccctgatgaagctggggacactgtgtttgtaaattctgatgaagcttttttgccagaaggaacagctttcccatctccagtagtggcaacatcccctccctgacccatgctgccatcagcctttccacctttgtctgaggagataaaccctgcactgcctgaggtaacagtgatggcctccagtgaggcagttgccagacaggataatgttgattctcctcagaagccacccccaacacctctgtttgcttctagacctatcactagactaaagtcatggtgggcccctagaggtgaggttgaaagtgtgacccctgaggaggtgtgctacacttgaaaacaactgtctgagttctccaaattacataaacagaaatctggagaacaggaatgggaatggatacaaagggcatgggataatggtggaagcaacatagaattggatcaggcagaatttattgatttgggcccactaagtagggactctgcacttaattttgcagctcagggagttaaaaaaaggttttaatagtttacttgcttggttagctgaaatatggattaaaagatggcccactgtgagagagctggaaatgcctgatctcccttggtttaatgtagaggaagggatccaaaggcttaggaagattgggatcgtagattgtattcatcactttagacctgctcatcgcacctgggagggtccagaagatatacccttgacccatgccttgtgaaatagatttatgagagcagtacttgcatttttgaagagcattatagttgtccttttctgcatattaggttccctaaaggtgggaaccacaattactcagctacaaaatttaaatacaatgggaataattggatccttaggtggcagaggccaagtggcagcactcgactgtcaaaggcaaggtgggcatagctaccatcatggacaaaagaggcaaagcagcaatcgtgtagagctctggcattggctaattaatcacagtattcctagaagtgaaattgatgggaagcttactgcattcccacttaaattatacaaacagaaaacttgtaggtcgaatggacaaaatactaacttgaattataaaaacagagaatcatggccccttaatcaatttccagacttgagccagtttacagaaccagaagctcttgaatgaaggggaggccgggtccccttgaggaaggaccacactacattaccaacaatttatgtagtgaatctttcacccatctttccccaaggagaccactggccttttaccagggtaactgtgcactggggaaagggaaatgatcagacgtttggggactagtggatactggctctgagctgatgttgattccaggcaactcataatgtcaatgtggtccttcagttaaagtaggggcttatggaggtcaggtaattaatggagttttagctcaggtctgacttacagtgggtccaatgagtcactggactcatcctgtggtcattcacccagtgccagaattcataattggcatagacatacttaacagctggcagaacccccacattggctccctgactggtagggtgaggactaattatggtgggagaggccaaatggaagccattagagctgcctctacctagaaaattgtaaattaaaaacaatatcacatccctggagggattgcagagattagtgccaccattaaggacttgaaagacacagaggtggtgattcccactacatccctgttaaattctcccatttggcctgtacagaagacagatggatcttggagaatgacagtggattactgtaatcttaaccaagtggtgactccaattgcagctactgtaccagatgtggtttgattgcttgagcaaaatgacacatcacctggtacctggtatgcaaccattgactgcacaaatgcctttttctccattcctgtttataagccccaccagaagcaatttgccttcagctggcaaggacagcaatatacctttactgtcctaccacaggggtatctctactctccgtctttgtcataatatttttggagagcccttagtccctttttgcttccagaagatatcacactggtccattacattgatgacattatgctgattggatccagggagcaagaagtagtaaacacattggagacacttgcatgccagaggatgggaaataaatctgactaaaattgagggataatctacctcagtaaaatttctaggggttctgtggtttggggcctgttgagatattctaaagtagagaataaattgctgtatttgaccctcctacaaccaagaaagaggcacaatgcctagtagggttatttggattttggaggcaatacattcctcatttgggtgtgttactccagaccatttactcagtgacccccaaaggctgccagttttgggtggggtccagaacagaagaaggctctgcaacaggtccaggctgctgtgcaagttgtctgccacttggcacatatgacctagcagatccaatggtgcttgaggtttcagtgtcagatagggatgctgtttggagcccttggcaggctcccataggggaatcacagcaaaggcctctaagattttggagcaagaacctgtcatcttctgcagataactactctccttttaagagacagctcttgacctgttactgggctttggtggaaactgaatgtttgactatgggtcatcaagtcactatgcaacctgtactgcctatcatgaactgggtgctttctgacccatctagccataaagtgggtcatgcacagcaccattccatcatcaaatggaagttgtatatacatgattgggcacgcttgagcagtcctggaggcacaagtaaattacatgaggaagtagcttaaatgcccatggtcttttcaccccagccaccctgccttctctcccccagcctgcaccaatggcctcatgtggagttccctatgatcagttgaccgaggaagagaagagaagactagggcctggttcagacagctctgcacgatatgcaggcaccacccaaaagtggacagctgcagcacaacagcccatttctaggacatccctgaaggaccgtggtgaagggaaatcttcccagtgggcagaactttgagcagtgcacctggttgtgcactttgcatggaaggagaaatggccagatatgcgattatatactgattcatgaggtgtagccaatggtttggctggatggtcagggacttgcaaaaagtatgattggaaaattggtgacaaagaaatttaggaaaggagtttgtgtatggacctctctcagtggtcaaaaactgtgaagatatttgtatcccatgtgaatgctcaccaacaggtgacctcagtggaggaggagtttaataatcaagtggataggatgacccattctctggacaccactcagcctctttctccagccaccgctgtcattgcccaatgagccaatgaacaaagaggccatggtggcagggatggaggttatgcatgggctcagcaacatgaacttccactcaccagggctgaccttgctatggccactgctgggtgctcagttttccagcagcagagatcaacaccaagcccttgatatagcaccattcctttgggtaatcagccagctacctggtggcagattaattatattggacctcttccatcatggaaagaacaaaggtttgcccccacaggaatagacacttactccagatatgggtttgcctatcctgcatgcaatgcttctgccaagattaccatccatggactcacggaatgccttatccaccatcacggtattccacacagcattgcctctgatgaaagcactctatggctaaagaagtgcagcagtgagctcaggcttatggaattcactggtcttaccatgttccccatcatcctgaagcagctggattgatagaacggtggaatggtcttttgaagtcacaattacaacaccaactaggtgacaatgctctgccaggctggggcaaagttctccagaaggccatgtatgctctgaatcaccatccaatatatggtactgtttctctcgtagccaggattcatgggtccaggaatcaaggggtggaagtggaagtggcaccactcaccatcaccactagtgagccactagcaaaatttttgcttcctgttcctgcaacattacgttctgctggtctagaggtcttagttccaaagggaggaacgttgccaccaggagacacaacaacaattccattgaactgaaagttaagttcggcacctggacactttgggctcttcctacctttaagttaacaggttaagaagggagttacagtgttggctggggtgattgatgcagactatcaagatgaaatcagtctactactccacaatagaggtaaggaagagtatgcatggaatacaggagatccattagggcgtcttttagtattaccatgccctgtgattaaggtcaatgggaaactatgacagctcaatccaggcaggattacaaatgatccagacccttcaggaatgaaggtttaggtcaccccaccaggaaaaaaaccacaacctgctgaggtgcttgctgaaggcaacaggaatacggaatgggtagtagaagaaggtagtcatcgttaccagctacaattatgtaccggctgcagaaacgaggactgtgtcatgagtatttcctccttcttttgttaaaaacatgtttctgcatgtatacacttgtaataagaaaatattttgatttttttccttttcctttatcatgtaacataagatttattgactccatatcagcatttaagtattgttaactttatgtaatagtatttgggttgggaattggtgccattttagttgtacgaaggatagctgtattatgttaagtgtaattatgacctcactattttctttatttgaagattatgtatgatctcaggacatgtctatggggtcaagttgacaagggtggacttatgatggttaatactgagtgtcaacttgattggattgaggaatatacagtattaattctgggtgtgtctgtgtgggtgttgcccaaaagtgattaatatttgagtcagtaggctggggaaggcagatctacccttaatctggtgtgcagaatctaatcatctgccagtgaatataaagcaggcagaaaaatgtgaaaggcatgactggcctagcctcccagcctacattttctcccttgctggatgctccccgctcttgaatattggactccaatttcttcagttttgggacttggactggctctccttgctcctcagcttgcagacagcctattgtgggaccttgtgattgtgtaagttaatactcaataaactctcctattagttctgtccctctcagagaactcctagaagtacagagtagaatagtgattactagaaactggtgaatcaggagaggagtgggaatggagagaatttgttcaactggtacaaagataatgctagataagaggaataatttctggtgttatattgtgcagtagggtgactacagttaataataatgtactatatatttcaaagtagctggaagagagaatcttgaaatgttatcataacattgaaataagctaatcaccatgatatgattattatataatatatacatgtattgaaacatcacactgcaccccataaacttgtactattatatcagttataataatttaaaaactcatattaaaaatcttatagatctagttctaaaaaagctgaaatgtaatatgcaatgttccttatttttaaaagacaaatggttacaatgtttctgtttagaataaaagtagatctgtaccttaatatgacattgcacaggaggtttcagatacatagtaagtagatattttgggatggtgcatattcaaagtaaatgaaactgcataaagaatggtgcctggaatgaattatcctccacttgacactttcttcttcatttctcaatttaaaacaactgagcggccataggtaagagctctgaagaaaacaccgactcaacttgaatgcaggtcctactattactacctgtgaaacttggaaagtaatttacccatttcaaacatcactttcctcacttgtaaactgaaggcaattacagacctgcatcctagggttattattagaattaaatgatttaatacatgggtctttacactattatttatatctatgttctttttgttccttttttaacatatgatccattagcaacttcaaaaattatagtagaagattgatggtatgaagacatacctcattttattggacttcactttattgtgcttctcaggcatttcctttttaacaagttgtggcaaccccacattaagcaattatttcatcactatatttcttatagcatgtgctcactttgtgcctctgtgtcacattttggtaattcttgcaatactgcaaatggtttcattattattacatctgttatggtgatctgtgatcagtgatctttgatgtcctctgtaattgatttggagcaccacaaaccatgcccatgtaaaatggtgaacttaataaacgtgtgtgttctcactggtctactgcttggctatttcttaatctctctccctctccttgggtctccctattccctgaggcacaacagtattaataccaggccaattaatgacccaacaatggcttgtaagcatttaagtgaaaggaagaatcacacgtctctagctttaaatcaaaagctagaaatgggccaggtgccttagctcacacatttaattacaacactttgggaggcctaggcgagaggatcatttgagcctaggagtttgagaccagcctgggaaatatagcaaaacctcatctctacaaaaaaattaaaaaattagctgagcatacgggttcatgcctgtagtcccagctgctagggaggatgaaataggaggatcacttgggcccagggggtcgaggctgcagtgagccatgagtgtgccactgcactccaacctgggttacacatcaagactctgtgtgttaaaaaaagaggagagaaatgattaagcttagtgaagcttgtggaaaacctctaagataggcaaaaatctaggcctcttatgccaaacagttatccagatcttgaatgcaaagaaaacgtttttgaggaaagttaaaaatgctacatcagtgaacgtatagatgataagaaagcaaaacaggcttttgctgatgtgaagaaagtttgtgtggtctggctagatcaaatcagccacaacattcccttaagccaaagcctaaaccagagcaaagccctacctctcttcaattctatgaaggctgagagaggtaagacgctgcagaagaaaagatggaagctagccaaagtcagttcatgaggacttaaggaaagaagctgtctccacaatataaaacagcgaggtgaagcagcaagtgctgatttagaatgcagctaagataattgaggaagttgtttggttacattaaacaacagattttcaatgtagatgaaacagtctcataggggaaaaacatgctgtctagaactttgtagctggagagaagtcaatgccaggcttcaaaacgtcaaaagacaggctgactcttttgttagagtctaatgcagttgatgacttcagttgaaaccaatgctcatttaccattctgaaaatcttaaggaccttaaaaaatatgctaaatctactctgcctgtgctatgcaaatggcacaaaacttggacgacagactgcacgtttgtttatagcacggtttactgaatattttaagcccgctattgaaacctactgttcagaaaaagaagatttctttcaatatattactgttcattgacaaagcatctggtcacccaagagccgtgatggagatgtacaggagattcatgttgttttcatgactgctaacatagcatccattctgcagcccatggatcaaggagcaatttcgatgttcaagtctctttttctaaggaatacattttgtaaggctatagcggccacagatagtgattcatctgatggatcaaaaagcccattgaacaccttcaggaaaggattcaccattctagttgccattaagaacatttgtgacttacaagaggaggtcaacatcaataggagtttgtaaaaagttgattccagccctcagggatgactgaggtattcaaaagacttcattggaagatgtaactgcagatgtagtgaagctgcctagctgtctggagtaaatactgaggttcttgctctcacggccaaggaaattgagggtcgtggacacacacacacacacacacacacacacacacacacacacacacacacacacagagagagagagggagattggagcaggagtttaataggcataagaaaagaaccgctctctgtcatagagaggggtctgaagtgggttaccaagttgtagtaaaaatatcagggattttataagtggactagtgaggagggggtgtcttatcttcctaaggcccaaagatttagttgggaccaggtgtgctatctttttagagcagagttttctatcagctctcaccctgttccttgatcatgtaggcagactcagtctgtcctgctctgtgctgttttttgtttgtttgtattttgttttttgcttatctgggagggagagtttctgtgcctgttcccagacatcttcttacagctgcaggcatcccccctgtgtctgcttctagattccctatcttagtgtgcctgtgtctgcttctagattccctatcttagtgggcctaaggggaaaggaaagtgcttattaaggcgcactgtttttcctggggctcattgtataagtgtgaagtttggtgctcacccaggagactccccactccttccgtgcctgagttgtttatctgtgttttacagcctgatcttccaggctgtctttttctggaagagaagtgatttctttgaactgcatgaggttagaaagggagctatttatgctttttgttagaaggaaagttttctgcaggggactcttttcacttgaactgtctacccaaataatttctttctatcttctacaacttatttctcctctcaggaatggaatacctaatggctgttagggggaattgggcgatgacttcttcaggctactttctgctggagggaggtgttgtgtggggaacagcagctagggctcctcctgaggtcgatctcagtgtctctggtagacgtaaatggcattttcatttttggctccatttgcagcaccatctgaagcttgatggcttgtaagtgagaagagataacctttacaaggaggtttagaatatagggtccaaggctgggcacggtgcctcacgcctgtaatcccagcactttgggagccggaggcaggtggatcgcgaggtcagaagttcaataccaccctggccaagatggtgaaaccccatctctactaaaaatacaaaaattagcagagtgttgtggtgggtgcctgtaatcccagctacttgggaggctgaggcaaataactgcttgaacccgggaggcagaggttgcagtgagccaagattgcactactgcactccagcctgggcaacagagtgagactccatctcaaaaaaaaaaaaaaaaaggaatataaggtccaaatgtgagtattaagactaccattattagcgggggcactgtaggccataaccatgacaacagagtttatttgatacctgtgaaccatttagatggtttgtgttgttgtaagtgggtgtatggggcttggctttgttcagcttccttggtcttactttctccaaaaaaacgaaacctctgggttataggttatctggcaggatttgcaggataattgcccagaactagaacattgttcaagattttctacattacccatccctttttgttttccttgagacacagctggagatttgtggttggctcacaggaataagcatggttagtttaaaatgtaggcaaaaacttaaaaacaactgagactagaagttaatagaagatttatgaagttttaaaagataatttttctctttagtcctcaattttgttaaaaacaacttatgataggactgagctgtttgcaaaataaactttagtcttatacttgtcctgattatttgcataaagcacagcaagagtgatcacctttacataggccttttttattggctttgatggaactctgtttcacaaggaatctcagatgggactttttaaagccaagcccagccatgggtttgtaccttcaaatacctgtgaattgggtaaacttcttttttcttgaggttccaagagcgtggggttcctaggcctgttagtgacattgtttactcactgcaggttaggaaccctgtctacacaggggctgtgtagacaaggtgtgaggccagttccccaaggggcttttattggctttgcaagtcaagcttgactccttaaagggaaatacaccctttcagtcaaagtcttggtaaaacaaccagtttttccaattgtgtcctgttgcaaaacgaaatggattcttattgcactgatgcaaacaactatattgttataagttgagaatacttgcaaccagtttctgaattctagaggaaccaggcagagcaaacaaatatgtttcaaaccttgtttacaggagtataccttacttagttgttaaaggctgtagttagctcaagacaggtttccttaagggtcagcaatgttccaagcataagtcaaaaaattgctttagttttctatagttcagtccattccattaactctcattctgcttgatatttgtaaacatttcagctttttatgagtcctgtacatttttctgttatcagaaacctgcatttaagagcacctattaaaattccacagatgattataaactattttttattttgaacaagatgaaaacaagataaaaattgtctgtaaatgacaaaatgtccagggtggttacaatcaagagcatgattgacaaatttgattattaccattggcttacaataacccaacataacaaccttaattgtgattaatagcacatattttgacactagaaccttagacatcccatacagttttggaacatattttaatattattctctaagatataacctggagtgcattagacatcattttggcaattccatgtacctaaacatgttaaataatcctgtttacctctcttccggatgctccaggggccctctgtagcacccaaaagctagggatcaggaaagacaaccttgagactaaagtttgattttgggaacctgttaaagatgttcaaaatttaaaacacttggtattatgaaatagaattttagattaccattagttacttatttttccaaaacgatgagtcaaaaatttgaaaaagcaaaaaccactcatcagctttttctattacacgaaaagcatgttcaagagaggaagttagattttacccttgcattaatttgctattaatgttaaacctaattttttaatgaaaccttatagacaattctattcaatcttaaccagtttgaccataaggtgagatttttacatacctgttataattgatgagttttgctaaagagcagattagcattttaagaaaaccttgttgcgcttttatttcagagtttaatttacagaaaaaaatacccttctgaattttgttaatagtttcacacagagtttcctttgcaagattaatttttacaatcttttcacaatttgcttaaaccttccactttaatttaatttaagacaattctttatttctagggagaatgtacatgtccatgccttcttataatctttaactaaaaacatcttttactgttttttttactcacctcgtatgcaaatccatgttcagtagtctcaattacatgtcatagctcttagcaatttttcacttcaatgtaaaacctgatacgttgttttaattatgtactagatacagataaagtatgactcctttcagcatagttagggtcatggttacttccatatgttcctaggccttgccaattgtgaagcaggtaagttgacagtttttaaaggccaaagaagcagttacaaccttaaaacatttagcaaacctagtatctgacctgtataatttagaccacatatttacacctttgaagacgtttgtattttaccaataattcctaacactgtttttatttttaaagattaaagttccgtgaactgaaaggtaccacagcttttacttttctcttaaaaatatttgatttaagtgcttatttttcttaggaaaattaattagagctctttttaaatagacactacacacataacacatatgtaaccacacagacaaacagaagaagatccagtagttataagatttttcatttgctaatttcccaattggattattggcctgctggtgagaccctttaagaacagggccaggaagacagtttccagggcctaataaccaagcatagccagaagacaaagacagattttgagaggtattaattcacctctaattccaggagttccatgaggaaaatagagattttttttccaaaatgggatttgtggcaacttttctgttttccctaggagtccctggccaccagaagttattttagggtctttcatgcatgcaccaagggtgtcaagacacagtgaaaaaaagtaatacagttgactgagaaaaaaaccttttccaggaaaactagatctatgaagagaaaaacataaagcctttaaaatatacccatagcttggatatccactttcaattaagctgagcgctctttaagaaaatcctttttcattaattaaaccattacagagaatgtaaacagtgattcttaccatttttttccccaatttgcaccactacctgttcacagtcacatttagtttcttcagttttctctgggagaaagtggctgggctcaggcaagggcagtttttcaactggactgcagatccctttagcagcaaagcttgataattgaggaggcaattgtctgttagctaaagcctttccttaaaggccagcagtcctgccatattgtgtggggtgtaaacagttaagttattccgcatggttaacctagtggcctctggcaccagcaaaaccactactacaactgtggtttgcaggaggcaggctgaccatactttagccacaaagctaagttccttggttaagtagccattggcttttgatctggacctgaagccatagttaaaacttccagggccatttccttcctttttgacagatagagactgaatgctttcccaacaggaagactgagggctggtattttaaggaaagcttgctttagctggttaaaggctttttgagcctcagattcccaagtgggggagggggtgagttttaaccttttgagtttttcttatgagatggtataaagggtgagccatttctctgtacccaggtactcatggtctgaaaaattcagtaatgcccaataatccccttaactgttaaaggaaatgggcttaatcttctcctcacctggtactctacttccttctaataagactagacctaggttctttactgaagtctgacagagctgagctttagattttgaaaccctatatccccttttagctaagaaattgaagagggtcttagtgccttcctgagacctccttggtcccaaccaaactaatattgttattattaggtgcagaggacagtgtcatttacacactgcaaagtttcaacttgagagtgagaaaaactagaaagaattttaaaaagggcctgtgtaagcaacttcctcccaatatagggggctttctgaggaatgaaccttttctttactgaattgggagacaaggaggtgtgttttattaaaacctctctcagtcttcctaaaaagtcagggagattttcatctggtttctggttcaacaaggacagtttagaataattaagaggtttggtcctagtcctttggccctctaatatgtacatttaaaagtgtttccttttccattcatctatggggtcacaggccatccagtcaggattgtcaagaagtatagcctctctacctattgggagtggtttttccattatttcctcaccttccttatctcgccttttcctttttgttctactataaagatatattattcatctctgaacttttctgctgctggaagagctggctgcttttcagctgcagtgagggtttggcctagaagcaacatagcatctctgcatgtaagattaaacacttgcgttaaattttggaaagcctgtatatatttatcagggtcatcagagaacctgcatatatccttctttatttgtctaaagtcttgaaataagcagggaactggtaccctagtggtgccccttccatctggcatttcttgtaggagtagtattgaaacttggacaatggggagctttggagatggtggagctggaggagctcatggtgcagttggaaggggcaccagatgagggaaactggaagcactggggcacttaggagtcacctccaatggttcctccaaaacttgctcttctgacttaggggaactactctccacagacctgcctgatttgattgctaagagggctgagtcgattgtgcaatgcttgatctaatagttggataatattaaaattaaggatcctttccacaggctaggtttgttcattcccaagatggtaagaaggccatggtaagaagatgtcgccttgtgcaaaagaaaatgagcagctttttctttagagtttttgggtcaaaggagttcaaaatgcactccagaggagtgtgggcctaagatggcttgctacccatcctagaaaagagacaagataaaaggcatcccttagtctccttgttctttttagtgtgacccagggtggaggggaagacagtgggggtgcccccaccgacggttctccctccttggtccctgggtcctagcaccataattgccaccctgtggttgcaggtatgaccctcaaacatgggaccagaggaagaagtcaatagggctagtcacaattgcctatgtgaccttattcctctgcctggtaattgccctttgacctccacgacttgtatgaactgcatggctccttgatggatgaatctcaggagagattatgtaacagttgcatttgagcaaggccccttaatggagggagtgtactggactgagctttatactctgctgttatagactggactagagaatttattcttaggtggtggttccagttaactttcagacataaaatcccctttctatttagatgccattctagttgtagacacaataggtgtcttaggaaaacataagggtcaaatggtggccttcctgctaatggagagagtattgagactaaaatttgtctttagaggacatttttctcctcactgctgaaagcagagttctcctgttcacagatggggcataaggtttggtctctagcagagggacgtaaaagggagaagaattggaaagctagagagaggcttttggcaaagggcagacaaggttctgcatggagcggattcctattccactaggtggaggtgtaagccttgaaataccaggcagtaactttgcctccatatgctctctaaacaaaggatggagagggaagtctgacatttggcaagctgtccccacagcatacctcctagcaggagaaggttacttcgcctcacagagggactatccagtttgactgggcagtgctgtctccttacatggaaaaagaaatagcctacatggagagacggacattcactggggtagggagtaacctcctactcaaccccaggaagtgttatcattaggagttaaatagtctttgagatctggaacatgaaatccccctgtctgtagaaagtcacaaaaacagcaatcccttgacctgcatgcctggttgctaagcctgcctaattgaattatttcccagggctgtaaaaactcttgtagcattgcatacagagaggggatgggagacatggtgaccatggaaaggaaaggaggaaaataaaatttgcaataggaaagcttggagatcctatgtctgacaaccagtcgggcatagggggctggttggggctagggtcagcctaggagcctgtggacaacaccagggtgtagctctggtcagaaatcctcagttgctccaggacctattccagccctgcacaacggcaaagttctccattaaaggaaacttgcttggacagagccaacattcctagcaccccgagggtactgggggattgactaagtcctccccagcaagcttcacatctgagtcttcaagaccggtggctagccctcatggctcattaatcagctgacagatgcttggtttttaaaatagttctttgagagaataaaaactgagtacaggaaaccttggaaatgaaagtaaagagtctgctcctttacgcacttttctgatgaatttgccttctaatcctaggcgagcccccaaaatgaagcagctttattgtctggggtaaatcttccaggctgctctttgttagaagagaagtgatttctttgaactgcatgaggttagaaagggatttctgagcttctttttgttagatggaaagttttctgccagggaatctttttacactgtctatccaaataatttctttctatctcctataacagtagaaagagcaagagaactagatttagaagtggagcctgaatatgtgactgaattgctgcaatctcattttaaaacttgaatggctagggagttccttcctatggatgaccaaagacagtggtttcttgagatggagtctatccctggtgaagatgctgtgaacattgctgaaatgacaataaagtatttagaatattatataaacttagttgataaagcagtggtagagtttgagaggattgactccaatttttaaagttctactctgggtaaaattctatcaaacagcatcacatactacagagaaatattttgtgaaagaagtcaattgatgtggcaaactcactgttgtctttttttttttttttttttttttttgagatggcgtctcactctgtggcccaggctggagtgcagtggcgtgatctcggctcactgcaagctccgcctcccgggttcacaccattctcctgcctcagcctcccaagtagctgggactacaggcgcccgcaccttgcctggctaattttttgtatttttagtagaaatggggtttcactgtgttagccaggatggtctcaatctcctgacctcgtgagccactgttgtcttattttaagaaattgtcacagccactcaagccttcagcagatcccaccgtgatcagtcagaagccatcaacatataggaccagctggtggtgcctccaccagcaaaagtattaggacttgccaaaggctcagatgattgttagcaatttttaggaataatatatttttagattaagatacatacatggttttttagatatcatttgattgcaaactgagtaggctacagtatagtgtaaacataacttttctatgcactgggaaagaaaaaaaattgtgacttggtttattgtgatatttacttttttgtggtggcctgaaacccaacccgtaatatctccaaacccgtatttcaggctcatataatgttaatgttgctgtgtgaatatctggtatctaaagggtatctaaagcatatgactttcatgtcagtatacacttgccagcgagctcacgcttaattgagtatgccacaggttccaccagaagttcaagagaaatgagtgaagtgaaagagagatggaatgagagagagagagagaggaaaaagttttatgatcttttaatatcattttaatatcaagttagatgactctgattgtccttggaaatgctcttgcagaaatgtgattcatattgggggctcaacttttattgaggattgaattaagttttggtcatataaacaacaattttgaatctattttaatgacattttcttcaatggtcaatttttaatattttaatttaattttcattgtcaccatttggtattataaagcttatgcaatcaacttgatgcaattttagtgagatcagttactactcatcactgttgcataatttgtaaatgtgaactggaagtaaaaattttcactcaacatttccaactttagaagtgccgttattgtggagtgttgttatatttatgtaaattctgtaattataacaaggtgaacagagttttgccttatagatagactattacagtatagcagaaaaagtgggagctttggagtagatagatatgggtttgatccttgctcagctactagcagcgattttggttaaatcagttaaatcagtttttctgagcctcaggatttttttttttatttttcatttggattagtaatatatctctaaatgagttgttggaggacttcactaaatattgtatgtaaaacatctatcaagtttttgcatgcaaataactacttttgaaaaatttgaatttttcactttgtcaggctactcccttgaacttctccactggtcaccatttatacagaatacaatgcaaatggcacatcctagaattatgcaatctgtagcccttgtttgcatttaaaaatatctgtatccggctgggtgcggtggctcacgcctgtgatcccagcactttgggaggctgagatgggtgaatcacgaggtcaggagtttgagagcagcccggccaacatggtgaaactccatctctacaaaaaattagctgggcatagtggcagccacctgtaatttcagctacttggagggctgaggcaggagaattgcttgaacccaggaggcggaggttgtagtgagccaagactgtgccactgcactccagttcgggtgatggagtgagtgagactctgtaaaagttaaaaaattatacatacacacacacacacacacacacacatatatatatatatatataattttttaacttttattttggattcagcagggtatatatgcagttttgttgcaaaggtatattgggtgatgctgaggtttggagtgcgaatgaatctgtcactcaggcagtgagcataatactcaataggtagtttttcttctcttgcccttctccctccttgtccctcctgtgtcctccagtatttgttttcctcatccttatgtccatgtgtaaccaatgtttcgcttccacttgtaagtgagaacatatggttaaaaaatctatttattaagggatttttacattctaggtaataaagaggtaaatttcaggttggttgtgttcaaaaccattccaaatggcactaccttttgtatgtaatgaagacgtcaattgaaggaaataaccatcaatcggttcatgtatccatccacccatctactcatgtattcattcatttaacagatatttttcaagagttgactgtgtaccaggcaccatcatagacacttaaatctgtatgagtggatgaaaatgaaatacagatttgaacttgagtaattacacccaccctgagggataaaattatacaattacttttttaaaaataagcattctctggtagtagatataaactaaataagatatctggaaatctttatacttcctcttcattcaggagatctgcccaatattctttcagttgtcactatgaaatattgggcactttagaaaatgaatagtgaaacataaatggaaaggagctgttaattataaatactccttttatcattacttgcagattctggtgctttacctgcctctggctttgtttctcaccaagacacacatacatcattctcaggccagtctttctccttaagctttaagaaatttttagagaaaaagaaatgttagattgagattcctattatttttcactgattggcaattccaggtaaatcaatgtttttgaataagggacaaaattaaatagtggtaaaggtgtcaagggtggattattttccccctgtccctgttacagaatgaagctatcatgagtacaagaaaaaaggtaggacgaaaagttagtgttgtaaacattaaagcttttctgtggtttcagttatctcagaattgtcattaggtttaagagacataaggaacattagaaatcatttagtttgctctcttattttatagatgaggaagaaaatttaagaaaatgaaattacttgtttttggtagctcaaatagccattggaacttagtttttgagacacagcccagtgatcttcgtggcatatcaagcttattcttgattttctcttgttaattattttattcacctccatgactttaaaggatatctggaacaagtctttctttgcaaatcacattaaattattatgttggtatttttagctttaatttctgcatttgtgtatttctcaatcttccttataatttaccaccttttaccattactgcaatacttgtttttttcttcctcatttgttactttatttctcagcagatttctttatttttttcatttctcatcagaaatatcatttactatgactacatactaaaacatgaaaataattaaatttactccaagcatactaactttcattttaatctgtctctatgcatcaagcagggtaccatattccttttgatagtggatattgtacaaggactgagagaacgaaaatcttagtctagatatctgccgtgtattaaacttttgggagagaagcatatattgtacttgtgagcatattattagtaatgtaatatggtaatagaagtatctcattgggggagtcattcacttaaacaatttcattttcacagatgaccattaatctgaaagtacaagttgaaggtaaaataaggaaaagtactcaaaattgatttttcaagtaacaattctaagaaacctattaagttaatccccatgcagtattgtttttaaccattaatatttttgaacttgtctctcatttcccgagaggaacaaaatgatctgaatatgtttacttcagcagaagttggaaaaagcaacaaaaaaagaaagttcaaaagaaaaatgacctttgattttgagacctgggacttcgtttcagctttgagtctctaaacatatgttctgaagtctgcttccatttgggtttgagaggattctgcctatacctagatttcaagtcattcaccttcaattcctgaattgcaattagatagagtataagccttttttcttgcccccactttcccttcttgctttttaggacagcaatctgaaaaggttgagtgaataggttaccattttctgcatctctagtagtctgactgataaagctattaaataaaggcaaactgtaattctctcttatctacatgcctcatttatgctctttgccctggagaagagctgcattaaagatcagagtgttgttgaaaactcctgaaaaataataaattgcttgatcactcaaacaatgacacgattccttgggaaaacagattttactgtgtatgtgcggatggggaggggtattcatcctgaaggattgaagtggtgtgatgagggtggaaaaattatacataaaggactgctggagaaacataaagagaagctggaacatctatatgataaatacacttataattagtgagatcattagcacaaacagagtatactttggtatccgtaaagaagtctttaagctaggcagttagcttcactatgaagggggaaaaaaaaatgagctatatacagctgaataggcttttcagtctccaaggaggtgacttgtctgttgatggccagtgggggtggaagagtgaaataattacttaacagcatgtaaacaaagtgagatgtgaagtatgcttccctgctcccctcccttttcattgagagagtttcttgttgtgatggctccagtgggagaggcagcagagaaatttgattaaatggatgcctggggtcatgaccctgtctaaacatggttcagctctcagcatcaatcaaataaattttttttttcttacttaagaaaaatctgatcttgctgtatatgagtaccagtgagctttggatttggtggtggttcagtaggggttgtgtaagtctgtgttagcattctgtttacagaaaaataactgaagaagaggcagtcttctgggacaacagaaacctatagctttattttagatcatgttatgggactttcatttgacgatagcctatcaacagcctgtgggatttggagttccattagaatttactaggactcatttattgcaaaccattgcggacattgatctgagtgtttggaagatatttatagtgttgttgatgtgggattcctgtgttcaggaactctcttaggatagttttatttggggctagtgtttgaaagcagcttggaagtgatttttctttgaaaatggagaaaactgtgtttgttgagataactagaatagtggtcactggtgacgccaataagagcaacaaaattggaacttttctaagcacacaagtgccattgtattaaagagaatatttgctttggatgacagacttgtcattaattcttgttttaagaaagaggacaattttaatacaattaaatagttgtttccttcataggaattgacacagaagagtgtacaacctattttagatcatcaaaatcttattttttccaaataagaaagcttttgtatgagaatgtggatggcttacatcaaaaatcttgattaacttagaatcataaggcaaggaggttccagctaattgaaattaatcatgtttgtgttgttaatccttgttgaaaataattttaataaatattatcccattttattgcctgccttagcattgtacagtaaatatgaattcaactttagttggatgattgaaatcttactgcctcagaatcagctttctactcatcaattttaattagacaacaagatggataaaattatagaaggtgcaagagcttggtcttactgtcttagaatgtgcttggaagtcagtgatgtgttatgaaataataataattttaaaaacaacacctctaagtaattttaaaatactttttcttaatggtagtatataattaaatggtgttaattgactgcattatataattaaattctggataatcaaggtacgtaatttgggtctttggatagcagttgattgaagatatgtttgcatgtttttgtgaagtaagcatacttcttacaatacttttagacagtaatatataggagcttaagaaatactaaaatgaaaagtattttcccatgaggtggataatttagactgttctggccatgaccatgtggattttgtcctgagttcctaatttgaacaactacaaagaacatgatttcaaatatacagagttcatttgaaccaagtatactatttacacatgaaattttactttaagaaaaccacagtttcattgttatttggggaaaatgggaaagaaggagtatatttttcactagagaattatgattcaaaccagttggactgtaaagtataaaacaccagccttgtatttgaacttggaaagttactttcaaagcctacccactcaccatggagtttgcacatgtcaaatcaaaccgtttttgctattattatagcaaaacatcattggatgaaaggtttatcaagttactcctgttgagatatttacaagagtcgaggctgtcggcgtcagtaaatgcaggttcccattgacacaaactaacccaatgtggttagttatactgcttcatgacacctgggctttaaaataacagcagggtcacttggataacatttcagacaagggctcatttctgaaattttgctgctacctcgagctttagaatattaaatacactaaattagaatgtaaatcctggaagataaaacaaacaaacaaacaaacaaacaaaaaaacagaagtaagcctgtctgaagtctaattgtcacttactggtgcctgtcctccaggctgacattgctattagatagggctttttataggaaggcttttacaaaaggggaaaatggcagaaaaatgtgcatatcatatcagggaattatagaaattctcaacacttctattgattgatattttactgtcagatatatacttttaagcataatttcaaaaattatagattaatattaaaaatacactatacaagtgtcaactctttcaacttgcagtgtatgtgatgggtttgatatggggaggaagattagagacgtgacccaattctaggatgttacccttcagcaacctgctcatgctagtgatgatacatgtacagagtgagtatatcaagacactgggaggttctgagccattggaaaaaaataaaagttgaattatatttcctatctgcgtttataagactcagtttgaaaagatttttcaccgacatggagttttctgagttttctctttaatacttggttaacctgaaaattaagctaagcaaaagctcagatttgcctgaacagtatagtgactgaggtttcattacgtattgaagatagtgctttaaatttatggttatatagtcactaagcttggaatccagaaaacattgtatgtggtaggtaaaatttttatggcatgttgatatatgtcccttagtggtcggagctatttatttctcactttattttgtaacaaacaaaatactttaattttaaaatgccttgattcttcaataacagtgttgcccagttaataaatactactttccaggatactaaattgtatctaagaatcataattgtggcctccgactaccaggtattggttctatttttgtatgagtagtctaatagtgcatatcaaaaagtactttaatccctaaagagtaaaatgaggcagattctgactgcagtccggtctttaccattgaactcaacttcttaatgaaagttagtcaatctgcaaattaatgattatagtatttcttcaatttttatttttgtatgtgtgtattcagataacatattaaaacctttttgagttctttagagaaatattataaacgtaacactaacatctctaaagcacagggacctgaaaaaaatgtactgatagcatcagagaattagttatgatagtaaaaattataccaaattgaatacttttttaaaaagacagatttaaattctgaatatttctttgtcttttgtgtttgctttggagtagaaggctaaaattccataattcaagttagagaattccagtgcaatatattataacaagtttgtttcatctcaccaaatgtataagatcataacagaggaataaaatacattgaggataataaaagtatgtgtgtatttgtgcatgtgttatagtctgcttaatgctatcattttaatcaagctttcagtaatttatgcttattagtttttcactgatctgttgctgtgactaacactttataaatggataatatattaactcttctgcaaggaaaataaaacaacagtatagagacagtaccttgtgatttactatattcaaaatctagggataaacgactgtatgatttaatgctgctggatgtagactttttatattttctattgttccttctttaattctcttgatttccaatttttgaagtttttagacttagcaatgaccattaaatctattttttgaaacttcaaatgaaatacagcttaaaagatgaagtaattacatatttaaaaatcatgcacacttatgaaaaaggtgagcctattgtttaatttcaaaagactgtcatgaaagcctccattttactgcaagaaaaatgcaagagaggcttgctccctatctctgtgtgaattctccagtaagtctatgggaaggagtgaccttgctgaccttctcacactcttaacagtagcaagtgtggtcatttagtttgaactggaaacaaggggttcagaaagacagctagaaagctgacaacaagaattagtaactagtggacaagtccaaacataggcaaaaagtgcccttgaagacttaaatcaaataaacctgacaatcctttatgtactactcttttccccatactgattaaagaacaatagatatttgagggaaagtaatgagataggagaatttgtaagattaatttggtcaaaatgtttgatctttcataattattttacaattaaacttgaatgattatacttattaattttttttaatatactttaagttctgggatacatgtgccagaaagtgtaggtttgtcacatagctatacacttgccatggtggtttgctgcaaccatcaacccatcatctaattaggtatttctcctaatgctatccctctcctagtcccccaccacccagcaggccccagtgtgtgaggttcccctccctgtgtccatgtgttctcattgttcaactcccatttatgagtgagaacatacactgtttggttttctgttcttgtgttagtttgctgagaatgatggtttcgagtttcatccatgtcccttcaaaagacatgaattcatcctttttatggctacatagtattccatggtgtatatgtgccacattttctttatccagtctatcattgatgggcatttgggttggttccaagtccttgctattgtgaacagtgccacaataaacataagtgtttatgtgtctttatagtagaataatttataatccattgggtctacacccagtaatgggattgctgggtcaaaaggtattatttctaggtttagatccttgaggaattgccacactgtcttccatgatggttgaactaatttacacttccactaacagtgtaaaagcattcctatttctccacatcctctccagcatctgttgtttccttactttttaatgatcaccattctaactgatgtgagatggtatctcattgtgttttgatttgcatttctctaatgaccacagatgatgagccttttttcatatgtttgctgactgcataaatgtcttcttatgagaagtgtctgttcatattcttcacccactttttgatggggttgtttgtttttttctggtaaatttgtttaagttctttgtagaatctgaatattagccctttgtcagacagatttattgcaaacgtcttctcccattctgtaggttgcctgttcactctgatgatagtttcttttgctgtgcagaagctctttagtttagttagatcccatttctcaattttggcttttgttgccaatgcttttggtgttttagtcatgaagtgtgtgcccatgcctatgtcctgaatggtattgcctagcgtttcttctagggtttttatggttttaggtcttacctttaagtctttaatccatcttgatttaatttatgtataaggtataaggaaggggtccagtttcagttttctgcatatggctagccagttttcccaacaacatttattaaatacagaatcctttccccattgcttgttttgatcaggtttgtcaaagatcagatggttgtagatgtggggcactatttccgaggcctctgttctgttccatttttctacatatctgttttggtaccagtaccatgctgttttggttactgtagccttgtagtaaagtttgaagtcaggtagcatgatacctccagctttgttctttttgcttcttggctacacatgctcttttttggttccatataaaatttaaagtatttttttttctaattctatgaagaaactcaatggtagcttgatgggaataacattgaatctataaattacttctagcagtatggccattttcacaatactgattcttcctatccataacatgaaatgtttttccatgtatttgtgtcctttcttatttccttgagcagtggtttgtagttctccttgaataggtcctttacatcccttggaagttggattcctaggtattttattctctttgtagaaattgtgaaaggaacttcactcataatttggctctctgtctgttcttggtgtataggaatgcttgtgatttttgcacattgattttgtatcctgagactttgctgaagttgcttatcagcttaaggagattttgggctgagatgatggggttttctgaatatgcaatcatgtattctgcaaacagagacaatttgacttcctctcttcctatttgaatactttttattgctttcctttgcctgattgccctggccagaacttccaatactatgttgaataagagtggtgagagagggcatccgtgtcttgtgctggttgtcatagggcatgcttccagcttttgcctattcagtatgatattggctgtgggtttatcatgaacagctcttattattttgagatacgttccatcaatacctagtttattgagagtttttagcatgaagggctgttgaattttgttgaaggctttttctgcatctattgagataatcatgtggtttttgtcattggtcctgtttatgtgatagattacgtttattggtttgcatattttgaaccagccttgcttcccaggtatgaagccaacttgatcatggtggataagctttttgatgtgctgttggattcggtctgccagtattttattgaggatttctgcatctattttaatcagggctattggcctgaaattttctttttgtgtgtgtctctgccaggttttggtatcaggatgatgctggcctcataaaatgatttagggaggattccctctttttctattgtttggaatagtttcagaaagaatggtaccagctcctctttgtacctctggtagaattcagctgtgagtctgtctggtcctgggcttccagaggaaggaagaggcagcaatctttgctgttctgcagcctctgctggtgatacccaggcaaacagggtctggagtggaccttcagcaaactccagcagacctgcagcagatgggcctgactgttagagggaaaactaacaaacagaaaggaagagcatatccactcagagaccccatagaaggtcacccacatcaaagaccaaatgtagataaatccatgaagatggggagaaacaagtgcagaaaggcttaaaattctaaaaaccagaatgcctcttctcctccaaaggatcacaacttttcaccagcaagggaacaaaactggattgagaatgagtttcacaaatagacagaagtaggcttcagaaggtggataataataaactcctctgagctaaaggagcatgttctaacccaatgcaagaaagctaagaaccttgaaaacaggttagaccaattgctaactagaataacccatttagagaagaacataaatgacctgatagagctgaaaaacacagcatgagaactttgtgaagcatacacaagtatccatagctgaatcgatcaagcagaagaaaggatatcagagattgaagatcaacttaatgaaataaagtgagaagacaagattagagaaaaaagaatgaaaaagaatgaacaaagcctccaagaaatatgggaatatgtgaaaagatcaaatctatgtttgattggtgtacctgaaagtgacagggagaatggaaccaagttggaaaagactcttcaggatattacccaggagaacttcttcaacctatcaagacaggccaacattcaaattcaggaaatacagagaatgccacaaagatactcctcgagaagagcaactccaagacacataattctcagattcaccaaggttgaaatgaaggataaaatgttaagagcagccagtgagaaaggttgggttacccataaagggaagcctatcagaataacagctgatctctctgcagaaaccttacaagccagaagagagtgggggccaatattcaacattcttagagaaaataattttcaacccagaatttcatatccacccaaactaagcttcataagtgaaggagaaataaaattcttcacagacaagcaaacaccttacaagtctgccttacaagagctcctgaaagaagcactaaacatggaaaggaacaactggcaacagccagtgcaaaaacatacccaattgtaaaggccatcgacactatggaaaaactggattaactaataggcaaaataaccagctagcatcataatgacttgatcaaattcacacataacaatattaactttaaatgtaaatgggctaaataccctaattaaaagtcatagactggcaaattggataaagagtcaagacccatcagtgtgctgtattcaggagacccatctcatgtgcagagacacacacaggctcaaaataaagggatgtaggattatttaccaagtaaatggaaatcaaaaaaaatcaggggttgcagacctagtctctgataaaatagactttaactttaaaccaacaaagatcaaaagagacaaagaagggcattacataatggttaagggattaatgcaacaagaactatctatcctaaatatatatgcacccaatacgggagcactcaaattcataaagcaagttcttagagacctacaaagagacttaggctcctacacaataacagacagatactttaacatcccactgtaagtattagacagatcaacaagacacaaaattagtaaggatattcaggacttgaactctgctctggaccaagtggacctaatagacatctacagaactctccaccccaaatcaatagaatatacattcttctcagcaccacattacacttattctaaaattgaccacataattggaagtaaaacactctagagcaaatctgaaggaacagaaaatcataacagtctctcagaccacagcacaatcaaattagaactcaggattaagaagcttactcaaaactgcacaactacatggaaactgattgaacaacctgctcctgaaagactactgggtaaacaacaaaattaaggcataaatgaagatgttctttgaaaccaatgagaacaaagacacaacataccagaatctctgggacacatttaaggcagtgtttagagggaaatttatagcattaaatgcccacaattgaaagcaggaaagatcggaaatcaacaccctaacatcaaaattaaaagaactagcgaaacaagagcaaacaaattcaaaagctaggagaagacaagaaataactaagatcagagcagaactgaaggagatagagacatgaaaaacccttcaaaaaatcaatgaatccaggagctggttttttgaaaaggtcaacataatagatagaccattagccagactaataaagaagaaaagagaagaatcaaatagatgcaataaaaagtgataaaggggatatcaccactgatcccacagaaatacaaactaccatcagagaatactgtaaacatctctatgcaaataaactagaaaatctagaagaaatggataagttcctggacatatacatcctcccaagtctaaaccaggaagaagtcaaatccctgaatagaccaataacaagtactgaaattgaggcagtaattaatagcctaccaaccaaaaacagtccaggaccagacggattcacagctgaattctaccagaggtacaaagaggagttggtaccccgccttctgaaactattccaaacaatatgaatttatacctgccacaatataaaacagggagtatcattaaatctggtactatctcttaaagagaaatgacaatacctagtgatcaagaacttattccttatagaattgtttctcaagagatcagagcaagggactttaccattctatagttttaaatcttaaaggttcatttagtaagtaaagtagatcttacagactaagataaattttatgattaaatcttataatcttatgatatttgatttatcagaataatgattttaacaaacacatcccttactatgtggcgggcacaaacttgagcactttaatatattttaaacacattgaataaagacaacatccatatgaaataagtactattattattcctgtcttacagataaggaacctgaggcacaagaaggtcaaatgacttgctcaaggtcacatagctaataagtggtggagctcagagtctgtatgtatttcccaactctggcttcaaagtctatactcttaatccctgcaccacactgcctcttaggtttggtgcctgtttgctaggaaatcagaaaatggaaggaaaaagtctgaagatctgcaatagtttttaaaacttcatgctaaaagattcttcaaaatgctaatatgatgcatatccactataaattcaacccttcatgaggctaagtgaaattctagaaaataatacataaaatggccaggtaccataatattaaaactttgtcacagagatttctttatgttagaccaagaacttcttgattacataaagtgccttgatatactttgtacattatctttattgctaacctttatgaaatattttttaaaaagcttttgaaatctttatatctcctcagcacttacacaattaagaaatatcaataaaaacactatttttactttttacgtttggcttggctgattttcctaggataccttgtacaggcataccttgttttattgtgccttactttattgcacttagttgatattgtgtttttttacaaattaaaggtttgtggcaaccccggatcaaacaagtctatcagtgccattttccaacatcttgtgttcactttgggtttctgtttgacattttggtaattctcacaagtatgcaaacattttcattattattatatctgttatgatgatctatggtcagtgatctttgatgttatcactgtaattatttcggaacaccacaaaccacagcagtgtaaatggcaaacttaatcgctaaatgtctgcgtgttctcatcgctccactgattggtctttcctctatctctccccctctccttgggcgtccctattccctgagacacagcagtattaaaactagtccaagtaaacacccaacaatgccctctaagtgttcaagtgaaaggaagagtcacacatctctcactttaaaccaaaagctagaaatgattaagcttagcgaggaagacatgtcaaaaccctctgagataggccaaaagccaggcctcttacaaaaaacagtttgccaggtcatgaatgcaaaggaaatgttcttgagggaaattaaaaagtgctatgccagtgaacacacggataataaagtgaaacagccgtttgctgatgtgaagaaagtttgagtggtctggctagaagatcagatcagccacaacattttcttaagccaaagcctaatccagagcaaggccctaccggtcttcaattctgtgaatgctgagagagataagaagcttcagaagaaaagttggaagctagctgaagttggttcatgagatttaaggaaagaagctgtctccacagtatcaaagtgtgaggtgaagcagcaggtgctgatttagaatctggagcaagttatccagaagatccagctaagataattgaggaagttggttacattaaatagcagaatttcagtgtagatgaaacagtctcatagtgggaaaacatactgtctagaagtgggaaaacatactgtctagaacttttgtagctggagaaaagtcaatgccagccttcaaaacgtcgaaagacaggctgactctcttgttagagtctaatgctgttggtgactttagttgaaaccaatgctcatttaccattctgaaaatcctaaggcccttaaaaagtatgctaaaactactctgcctgtgctctacaaatggcacaagaaaacttagatgacagcatgtttgtttacagcacggcttaataaatattttaagcccactattgaaacctactgttcaggaaaaaaaaggatttctttcaatatattactgttcattgacaaagcatctggtcacccaagagccgtgatttgttttcatgcctgctaacatagcatccattctgcagcccatggatcaaggaacaatttcgatgttcaagtctctttttctaaggaatacattttgtaaggctacagcggccatagatagtgattcatctgatggatctggaaaaagcccattgaacaccttctggaaaagattcaccattctagttgcctttaagaacatttgtgattcacaagaggaggtcaatatatcaacatcaacaggagtttggaaaacgttgattccagccctcggggatgactgaggtattcaagacgtcagtggaggatgtaactgcagacatggtagaaagagcaagagaactagaattaaaagtggagcctgaagatgtgaatgaattgctgcaatctcatgctaaaacttgaatggctgaggagttgcttcttacggatgagcaaagacagtggtttcttgagatggaatctatccctggtaaagatgctgtgatcattgccaaaatgacaacaaagtatttagaatattacataaacgtagttgataaagcagtggtagcatttgagaggactgaatccaattttgaaataagtactactgtgagtaaaatgctatcaaacagcatgacatactacagggaaatattttgagaaagaagtcaattgatgtggcaaactcgctgttgtcttattttaagacagtttgcagccagtcatgatggctcatgtctgtattccaagacctttgtaagtctgatgtaggaggatctcttgagcccaggagttcaagaccagatggcgtaacacagggagaccctgtctctacaaaaaaataaaaaaaattagctgagttatgtggagcacacctatagtcccagatacccaggaagctaaagtgcaagccagactgcttgagcctgggagtgatgctgcaatgagcagtgattatgccactgcactccagcctgggtgttaatagagtgagaccctgtctcaagaaaataaaactaaattgggccaggtacggtggctcactcctgtaatcccactactttgggaggctgaggcagacagatcacttgatgtaaagaattcgagaccagcttggccaacatgacaaaaccccatttctactaaaaatacaaaaattagccaggcatggtggtgcacacctgtaatcacaggtactgaggaggctgaggcatgagaatcttttgaacccgggaatgagacgagatcaccccactgcactccagcctgggtgatggagtgagactctgtctcaagaaatataaataaataaattaattaattaattaaaaagagattgccacagccattctaaccctcagcagccaccaccctgaccagtcagcagccatcaacatgtaaacaagactgtccaccggcaaaaggattaggacttgccaaaggctcagatgattcttagcattttaaagcacaataattgtttaaattaagatatatacattggctttttagacatcatacagtttcacactttagtagactgcagtatagtgtaaacagaacttttgcatgcactgggcaacccataaatttgtgtgacttgttttattgtgatactggctttattaggatggtcttgaatttaatctataatatctctaaggtatgcctgtactactgttgaatttgggtaatggcttattctttatcaacaaaagtatatatcaatcaaggatccttattgagtgggaaaagagcctgcttctggtggagagatgtttaatttacaagttatcgaaagtggttgtgggcagagctgtttgatgtcttttcttatacttcagatattaagcttataataacagttcttgacaaggaaatggagacttagccctatcggtcactggtctgagtatgtttatgacatcaataccaatttgcatcatctgcccagagctgtgacttagagtttgagaaattacatgcatagagtcttctaatcattttcaatggaagaaatatttactttttaaaggcagcattcttctgcagtcatctattgtctagaggaaaagagagaatgtagcccaagcagtaaaggtcaagaataacagctaaagtgataatatccttggcattttacccattagggtttgaacttagagactttaagggtaaggtctttattaaggatttggctgtagactgagggtgtatcccaaggattagcaattaaaaatgtatataaaattatttgtaaacttgtatttattatattgatgtccttagaagacataatttaaaaacatttgccatctatttcatagaggacacatagtggaaacttggatccatattttaaaaaaatttatcattggagagtgtagaaggatgattaccagaggctgggaagggtagtggggggctggggaggaagtggggatggttaatggatacaaaaatatcatgagaaatactgaataagacctactacttgatacacaacagggtaactaaagtcaataatgacttattgtacatttttaaataactcaaaggtgtaattggattgtttgtaactcaaagaataaattcttgaggggatggccacctcactctccatgatgtgcttatttcacattgcatgcctgtatcaaaacatctcatatataccataaatatataccattactatgtacccacataaattaaaaataaaattaaataaataaacaaattccatcattggaagaacactggaaagaagcagcaaacagcaaggtattaatgatgtagactaaattaaaaggtacttggaagtgcatatatatatatatatatatacacacacacacattgaaatacgcattatgctgaaaattgatattgttttcagtcctcttgttaatatcctctacattattaatttttccaggtctctaggcttgaaaccttatgtttacttttttgttgtttctcttagccaatatatcaacaagaactatcaacacttattctgaaatgtgttttagagaaatcataccttttagttttatgttcttacttttcattctgacttaggctctcttcacttcctattgggaacttctttcaccaacttctactcccctttgcttctgtccacagtcacttttcctttctaatcctgcagatagatgcttttgcctaaacaccgcttttattatatttttttctgttcttatgtacttgtggtgacttatttgaatacttctgcaagatcttcagggttctgacagtctcctttccctttgtctcattgctcctagggaccaaacatacatttcacaactttctctctggttaacttctttttacaggattatctttctaagcccattaatgttcaaccaccttcaatgagtattaaattgtaaatacttgtgttttcttgtattctggatttcatgttactgataacctcctttagaaactctaaagtagttatgattaggaattccatagtcttacttgaatgagcagtattacaattgtattacttttcctttcatcttaaaacattaagcctttcaagttatttcctgttttcctataagatttctctttttttccccacaaaagtggtaattcaaaggcttaatatatctttaattaactgagcagggttgctaggaaaaaatgtccttatccagatgaagttgatatgtcagctgtggtttctttatccttatggactcaggaaatgggaagtatttaggttttgtcatgccttctttttcatggccaataaaccttattatagtagctccatgagtttaatatttcacacattaaatgattaaaagtaagaatgcaagacctctccatcaatagatttcctgacatgaattagattgtgtttttaaattccttgcaggaaaaaaaatagaaggaagaggaaaggaaggaaagattgtaaagaaaagatggagggagagagggagaaagttatgaggaaggaataaaggaaagaagcaaaaatgaaagaaaagatcaatgaagtacagaaaaagaaatgaaacatattttgaatcaaaatgtcctttcctagaggcgaaagcaattcagtattattcaagttttatttagtattattcaataaatttatcaaattttttagtaaatataacggaccatgcagcctcaagtcacacagactgcctgacaaggcaaggctggatttatgcatgtctcctgtttacccaagaatgcagacatttcccttacaaaatgagacggccttatctttattattatagggcattttagtttacagttttgctctgagtaacatttagatgcttttttcaagatccctaaataaaagaacagggaaaaatactgcttattgctagcaatctacattttttatattgcatgattaaaagcaagtattgctgacagcagaaaaataattgaaaatgatgattgtgatttatttatgtagaatctgtttgactaacagaaggtaaattgggctgatgaaaaaaccttgtttacattttttaaatataggccagattgtgatgacctggaaaatgaagtactggcaacatcaaagaagacattcctctttcttttaatctaatatttgccaaaattgccgtgatggtaaaacatatttacttgagtactagtacacagtgcacaataatttgcccaacccctagtcagggcataaattcatcctgttaccatttctcggactctgcaggctgaaagacagagttttctttgctatgggatacattttttttttttagcaaaaaccaaataatttagtgttaattgcattgcactactgatacctacagcaggtatcactttcgcatctcaggacaaacttagagtttcggattttatagatatctatccattccatgtcattaaaaaaaattgatataagttagagctgagagtatcattttcttctgaagataaaatcctataaactaaaatagcatgggttggagcagtatgtaccattttcatcttaagataaaaccccaaaaaacaaaacagctgacttgagctgaaacagtgcatgcatgctatctgtatactacaaatctgtttcttattttctcgctatatattcaaagtataagttcataaagttttaatagtgtttctcccttttccccatccaaattacatattgttctgttaaagatgaattaaaatatggatcccctatacttttttgtggtgattgtatgcactgaaaccttacggaagaaatgtgaccacatacaatcactgggagcatagactatttcattttagagttgagtataccctctgtgcctttatacattattatagtagtttttgattgtaaggttagggaagtgagtatacttttatttgttttattttatattttaattttatgctctaaaagtttagtgctctctagacataatgttttcatggagaactgttttgtaatgttaaacacagttatatttgcagttggccatacataataaagaattatcattatgaaaaattaatagaaaattttgggtagtgattcttctggtagaagtagttactaggcagtcttaaaggaattctgtgatgcccagagataatttttttattcaagaaattctaactattgaaattgtttaaaacaataacaagcgaggaaaaaccatcaatattcaaatcatcattatttcattagcttcgctgattctgtctctcaaagtattttgctctgattaagtgcaatttggattttcccaagccgtaaattaagcaatgaattgcccacaacagaatagttgaagtagtcagcaaagagaatttggtattcctctcccctcagcacatgggtgcacttgcacacatacgcaaaagcgcacacacacacacaccatttctatagttacagtctcactccaggaggtttgtctcttctaattagatacacataatccattcagctcatttgtaaagtttacaagttgattctctctcactctcttgtcttcactgtcttcaaccagacaatgaaaacaaagatacagtagagctcattttctcattattgatttcatgcaccagctgccagctgttttagcttgttcgtttatataaccctctgggcaacttttaaaaagtacatttctttgaccatctgctaaatacaattggtttaataattaaagactcaccattccattttaaagaaacataaatgttgctgttgcagctgagatatcaacattttggtttcaaatacagaaacaggtttcattccattaatcagtatcgtacactttgggacactagtatttcatgcttttttcttccatcagtttatgctaagaggaaaagttccttatcatttataaactttctgttgcagatcttattttccctctcagcttttgcttccagttgttaagtattgatacttaagcctgttgataccttgtttttataaacacataagtcgttgttgaatatacattcaggaaggcatatcagccggatgcactcataagaccacccgttataatgaatgcaggtatatttctagagagaatcaagctcatggcctccaccgtgccgcattgtttacaagtcaccatcctaccacccgtctttttcttagtaaaaggctagttcatgtacagacagaatcagagaacctcctacacaaacccttatcatctcggactgttgcaaaaatctactgttttgtcattaggtttatgagtgatgtgatgttttatgtgaagatggacgcaacttccatttgaactcttctttaaagctctgattagacttaaacattccaataattttgtactacttaacatgttatttggaaaactcttgtatataaaacaatttaccctttgtttccagggtatcttggaactgaaccataaatgtatagtcatatggggtgaaaaagtttatttcatttttatgccatttctatactattactgatgcattttgttacagaatcagtcagccatatacatcatctgcaaaattcatatttgctaaatttgttgaggaaattggagtacattttggattttcgaggtaaagttaatattttctttttttttaatcgaataaagccattttcttcaaaatggaaaaaaaggaacatttccttggtaaggtggacataacttatgttaacttctgtgaacctgagcatttgcactttgttttataaagtattcccctctttaatgtttttgtcattataagtgaaacagggaaagttcccttgttcccctctcagggcttgtgatgggggtgtggctctcttctttggtgtcccgctgctcataacccctagggggagcaggcagacgggcaggttgtggggagcatgggctccgacccctaggcagcatctaggggtgaatgcttagagctcccgaagccccagtgggcatgctacagtgtgctcttttagttttgccatctgtaggcagcttgtgttaatcagctcaattagaccctctgccttatcacaagaacagagagctttctgtatcccagggttctttccttggtgtaccagaagaattggatcactcgtgggcttggagaatttaagtgcaaggttttttattgagtggtagttctctgcgaggtggatggggaggccagaagggggatggagtgggaaagtgattttcccctggagtcaggccacccagctgtcaggctctcaccgaccacctgggccaaactccgcatcatttcgcctcgccggttgatggcctgctggtgtcagccggtacctgttggtgtgctcttccacctgtgtgttcctctctacatccagctgcttgtatctctgcccgctagggtctcagggtttttataggcacaggatgggggcgtggcaggccagggttgtcttggaaaatgcaacctttgggtgcgaaaacaggagtgcctgtcctcacctgggtcctagggcacaggcccagaaatggagccctcgccagggaccgtgcccttctcctcccagcacttccctgaacccttcccattcataaacacagctcgagtttagtcagttattaacgtattaacgttggttcctgttaattcttaaaatggacaagaacaagttgagctttccaagataatctggttaaatactcttatacatcaaattgatctcattctgattaaggtggtaaatttgaatgggaagctgcattttacagtaatcttttttttttaatttttctgtgattcttctcatcatggttctaatgcatctaatgcctcacaatcatttttatttttaaattgaaatattagatttatttacactacagttagttcaggccaggtgtggtggctcacgcctgtaatcccagcactttaggaggctgacgtgggctgatcacttgaggtcaggagtttgagaccagcctggccaacctggtgaaaccccccgtctctactaaaaatacaaaaattagccgtgcctgatggcgcatgcctgtagtcccagctactcaggaggctgaggcaggagaattgctccaacctgggaggcggaggttgcagtgagccgagatcacaacactgcactccagcctgggctacagagcgagacactgtctcaaaaacaaaacaagtgtctgttcatgtccttcgcccactttttgatggggttgtttgtttttttcttgtaaatttgtttgagttcattgtagattctggatattagccctttgtcagatgagtaggatgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcggctcttttttggttccatatgaactttaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtgtcctcttttatttccttgagcagtggtttgtagttctccttgaagaggtccttcacgtcccttgtaagttggattcctaggtattttattctctttgaagcaattgtgaatgggagttcacccatgatttggctctctgtttgtctgttgttggtgtataagaatgcttgtgatttttgtacattgattttgtatcctgagacgttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcagaaaaccagctcctggattcattgattttttgaagggttttttgtgtctctatttccttcagttctgctctgattttagttatttgttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccactctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaactttggcctgccttgctagattggggaagttctcctggataatatcctgcagagtgttttccaacttggttccattctccacatcactttcaggtacaccaatcagacgtgtctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggttgggggaggggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaataaaataaaaaaaaataaatgaaaaaaaaaaacaaaacaaaacaaaataaaacactacagttatttcactatattttaaatattctctttctatcttttattttatgtttagagggtatatgtgcaattttattccatgtgtaaattgtgtgttttggggatttggtgtacagttattttgtcacctaggtaataagcatagtacctcataggtagttttctgatcctcaccctccaccctcaagtaggcctcagtatctattgttcccttttttctgtccatgtgtacacaatgtttagctcccacttatacgtgaacatacgtggtatttggttttttgttcctgcattgatttgcttaggataatggcctccagctccatccatcttgctacagaggacatgatcttgttctttttatggctgcatagtatttcatggtgtccatacatatacacatctttgctattgtgaatagtgtggcgatgagcatatgtgtgtatatgtctttatggtagaatgatttacattcccttgggtgtatacccagtaataggattgctgggttgaatggcagttctgttttatgatctttgagaaatctccaaaccgctttccacagtggctgaactaattacattctgaccaatagtgtataagcattcccttttctctgccaccttgacagcactgttattttttcacttatttattcatttagagacaggatctcacttcgtcacccaggctgaagtgcagtggcgcaatttcagctcactgctgcctccacctcctgggctcaagcaatcctcctacatcagccctaaagtagctgggactacaggtgcgggccaccacacccagcctattttttgagttttaaataatagcctttctgactggcgtgagatggtatctcattgtggttttgatttgcatttctctagtgattagtgatgttaagtattttttcatatgcttgttggccacatgtaaaggtcttctttggagaagggtctgttcatgccctttgtccattttttaatggggttgtttcttttttgcttatttaattgtttaagttccttatagattctaaatattagacctttgttagatgcatagtttgccaatttttttttcccattctgtaggttgtttactctgttgataggttttttgctttgcaaaagctctttaatataatatttggtccaacttgtcaatatttcctttttttgcaattgctttcagtgtgttcattatgaaatctttgccagagcctatgtctaaaatagtatttcctaggttgtcttcaaggatttttataattttaggttttacatttaaatatttaatccatcttgagttgatttttgtatatggtgaaagaaaggggtccaatttcaatcttctgcatatggctagccagttatcccagcaccatttactgaatagggagtcctttccccattgtttgtttttgttaggtttgttgaagatcagatggttgtagatgtgtggccttatttctgagttctctattctgttctattggtctatgtgtctgttttttttagcagtaccatgttgttttcattactgtagccttgtagcatagttttaagttgggtaatgtgatgcctccagctttgctctttttgcttaagattgctttggctatttgggcttgttttgggttccatgcgaattttagaagaattgtttctaattctatgaaaaatatccttgatagcttgataggaatagcactgaatccgtaaattgctttggacaatatggccatttaaacaatattgattcttcctatccatgagcatggaatcacaaaatcatttttatttttattttttcatgttgttctgtaatttatttaaaaaaattaaaaaatgctagatcttggcagatatatgagttgaaaatattttttcaagctgtctttttactttcttttcttgaattttgttaatttcttagctttagggtacaagaagaggtttttggttgcttggatgcaatgtatagtggtgaagtctgagattttagtgcacgtatcactggagtagcatacactgtacctagtatgtaggtttttatccctttctcccctactctctgtcttctgagtctccatagtccattgtatcactctgtatgcctttgtatacccatagcttagctcccacttgtaagtgagaatatactgtattgaattttccattcctgagttacttcacttacaatggcctccagctccatccaagttacttactcctgcaagaatgaccattactaaaaagtcaaaaaaacacaaaatcattgttagaaacacaaccaactatgcaagcttacttgaaatggtcctctgagtggatttcctctgtgccttttaaaagttatattctgtatttgctttttaataaataaacttgtatttatcaaactcctgcttttgttatttttattacgcataatacataggattacaaatatcttgacacttagttctgtgttttagttttagggactagacaaagaacatgttttctgcattatagagctttaaactggttgggcacacaatgtttttcacatgtgaagcaacctgggctctctacaagaaaacataagaaacatagagataaatgtattccttacataagctagtgtaacttttagggtcatattacaaaggtaatgttttttatcctttgagtaaaattctgttatgtgacattcttcgtgtattttaataagttagaacagagcaataccatttgtattaaatatttttctgggcttattcaaacatacagccttaataaggtaatgttttagtattacatatatgctttccaactcattctttctttaacctggaaatcaaaggataaaaatcacttgttatacacacgtgtgcttgatcaaatggagtgaactgatgaaaggatattactaggtatcttgtttgtgtatttccatgttttatttggcatatccatgagacaaaagtatttatgactatcttctcccattcattcttcaatcaagggcttaggtcagtcttgtagggacagagaaagcagcacttgagctgagtttcaaggacaactagaagtttgttgggcagacaaaaaatgtgtgtgggtgtgtacaggtaatgggaacactacatttttggattgctctcctcttcacccaccctgttttatctttcttcatcctccctgtcatgtcctctcccacttcatcaccttgtattttcctgcaggattttgttaaatattataatttgagcaagctcaagagtagtccactatttaatgtttgctgtacagcaatatttctatataaaatatctcattagaaataattctgtctttcagccaagttgtaagagatagaaaaaaatcagtttagatctgtattctagctagagttctctgagtatatgtaagtgtttcttccaatcactttctcctttgcttaaacgggcttgttcttatttagttttaagtacgattcaaagtagatttacctgagatagaaatgtattttccaaattatgccatcccagccccgccacacacacacacacacacacacacacacacacacacacacacacacacaatcccagagagagctgggcagcaattatggagtgatggcaatgcccctacaagccctgctgataatcctcttctttgtaccctcttatcattaggctacctacaattgctggggagcaaactcagcaggagaatcttggccagaagcaatacccagtggcaagatggcaaggttaggtagtggaaaaattcctgatagaagctatttctttctcccagctcatctttgtttattcttgattggtaaaagaaaaaaaaaattctagtctcagttttgcaagtgactggtgaaaggatgatataaacatgttgtttaagactgaaatctgatgcactttccatacaaggccagttttcactggcctatatctgacatatgctagtaactgaatttggagggaaccttgagctccttggataagaagctaggcctgcagaatatcattgaagtttaaaaaactttcagatcagatttgaaaatgaggagctactgtcacagagccaggttgtatagccagtggaatgtgatacgttggtagatgttatgtattggtcaagaatgtggcatcagagaaagggagaaatagaaccattatattttgtcgtgtgtgtgtgtgtgtgtgtgtgtgtgtgtttgtgtgtgcatgtgtgtatttaattaaagagtgcctttaatttcttacaggtaattttattacaattaaaattaatttatattgattctggtgagaaatataaatgctattatcaaattcaaaataaaatataaagtcaaatgaaaaatttagataaaaatatattgcaatactagtttcatatgaaatgtcacctgtgaactgaactacattttgatactatacattaaaaatagccaccttccataatctgtgacattttgtattatcctagagtgcacgattttctaatagcattagatcagggaaagaaagcctaagcttgtatagtcacatagaagaccaagagaggccaggtgtggtggctcaaacctgtaatcccagcactttgggaggccaaggccaaaggattggttgaggccaggaattggagaccagcctggtcaacatagtgagacccaatctataccaacaatttttaaaattaactgcgtacagtggtgcacgtctgtagtcccagctacttgggaggctaaggggagagaatcgcttgagcccagctggtcaaaactacagtgagccatgattgtgccactatactccagccttgtgacagtgcaagaccctgtctcagttaaaaaaacaaaaacaaaaaaagaaaactaagagaaagctaagaaagtgttaagttcagacttcagctgaccaaaattccttctgcctgcccagcgagtacatttgattcttctgttcattttattttttatttttattttgagacagggttttgctctgatgctcaggctggagtacagtggtgcatgcaactagatcaccgctcgctgcagccttgacctcctgggctctagctatccctcacctcagcctcctgagtagctgggaccatacatgtgtgtcaccatgcctggataatttttatttttatttttgtagagatggggtctccctaggtggcctggactactctgtttattttagatttttggcttctcaaagattgtttccctctaattaaatattactcatttatataggatccagaacagtgtgttatacatctatatgtttttttcttttaagcactataatcctttatatgacagtaacacagaatcagatgtttatatatcatcattattgccagcctacagaatgatctctttcccaaggattttccccttatgccccacactttcattctgttgggcatttttctataaaacactgtgggaatgatatttggaacttgagggtaacatatacacatatacatatattcaagcacatatattaaaatggacatttctcattaatatctttttcttttgtttttccccaagaaaataaggtcattgaatttttcagtgtttgagaagcctataaatatttaaggaaaaaacacacttttacattttatcatatcaacccaatacatgctttcaccctatcgacacatttatgtaattgtatatgattcttccaaagtcctgcagctaatgtacattcctttttgatttaaatccatgtcctatcctttcctgagaagaattgaatctatctttatcatctctttgatagtaaaaaattttcgtaaaacaaaattaaatggtttcccagacaaacattttgaactcagataaataaccaatgtattttaaaaaaacatttttgccctaatagcattaagggaaatgaaacttatatattaaataatattttaatggtactttaatatttatttttgagtgataatccagaatgtgcatttttttgttgctgagcatattttgagttatagtatatgcttatatgctttaattgttattctgaagaaccctaaaaaaacctaccattaacacaaacattattgaactgaaacacatataaaacctgcaataaactttcagaagttaaagaacagcttatcttttttctactgcatctggcaatctgctaaaatttgaaaaactctttaaagtgtacctgcttttatagcatttttttcagcaaacaatatgtaacttgtataaatgcatataattttactattttgtgtgtagacctactgcttatctttgttttgaatggagtgtttaaggtagccaaaggcaaattatgaatatttctcaatatcataggttttaaaaatatgatttatatctgaagacgatggttattggaataatgatacatttttcagtttacatatgagcaaaataaaagatgcagttgaataattttcatttcattattttataccaatatttctaagagaactccaacaattatcttggtatttcatgacaggatctacctttcgagcaatccagtggtgtttcagtgtgtctcatcatagtaaggttatcattcattctgttaatattttatttctccataaaataaggtagttttatatttaagttaagtgtttaggggctttatttgcaagttgacaagatacagtgaatttaattgatgccattaagactttataatacatttttattcaaacagtataagcatatttgtactattacataaagatataaacttaataaattgtattcttttgtaaaatatcttaacatggtgtgcagtttgtgttaaacttacatcatttgacagaattacaaatatttcgaaatgaaaattcagttgaacaggaggaagtagaataaaatatatctatttttctcctctgggtattaagttcaatatggcagatgcaaagttatttatcttgcaacctttataaataatatattggagacctccaaactcatttaaaattcagaaataagaaaattaacttatcagttgttattttgacagttacaattgcaataattattaaatagtaaaatttcatctatattagtaaatctctttaatacctataaatgattatgcctgtagaaaaacatactgagattatatcccaaaaatccttagattactgtccctcttcactcagtaagtatttactcaatgtttagcaaatgttaggatttagaacaatgctagatactgtttaaacctaaatattcaaacaaaaagtcagtcagaagtgggacagttattatggaccaggatgaagatgaatgaggaacttttagtccaggattttagttctactctaaggtataaattcagagagaaaatgagagcctcttagtggcattaattttataaattattaaactgcacacgcatgcacacaaaactgagctgacggaaaaagcagatggccaaaaaataaacttaaaaaaattggctaaaatgtagaggtgattagctttagccaaaaccattgaaagaaatcaaaacaaatttaaggtgataaactaaataaaatagaaaactttaaaaaggaggattgttttgaaaaaagttcacaggagatccacaattaaaacacaattccacaattaacttgggggaatttgtttggaaatgacagcagattcctaattccatggcattcccccacacattataataattttcttaagtgaaaggaaaacatacacttaatgttttcttagacatttaatctctcccttttctagagccggtgcaaacagaactgctaattagtctaacatgtcaccaagctactgaactttgaaaagatagtagctctaaaatattgtagatgtgccagttgctaaacaggtgatttttcggtaccggtaccatattctagttttaacagatgggcttacttttaattgtgataatactagtagtctagatatcataataatagctttgagaggagcagttcattagtagcaaaaatcctttagtaaagtggcataggcttgaaactcagtgcttcaaagcactgtgggtactttaaatataggaaaataatgccagaatctagttcataatattgaccaattttcaatcaaaagaaaagttgattttagggaaaaaatatgtgacaataattcatattgtttagaatttactcctatttagtagtatttttccttagtaaaaattttccagttacacatgtaatatatgtttagattatatttaaggtatatcaaataagttagggtttcagtggcaaatttaggtgctttatctgtagtgagatttttgtaaagtttttctttaaaagatagcaattagagaaagataaattgaccttatgcttcattgttacttttcaggtgttcttggtgtttcaaataaattgcaaagaaaatttcccgtctggtaatgatccttcttacaactccacatcttgcaaaagtttttactgaaatattataggattaccattaaaataatttgatcatgtgtgtgatcctattggtacggtcatatgacaacatgataagtttcataattataacaatttaacagttgtcaaaagtatattataactgattttcaaaagtttgctataaagacagcttgtttctatctgtactcaattgtaaatatacatgattgctttcatcagtttcttctagtaagacaacaaaatagaaattttaatgatgacagttaatcataaaattatattttcttctgaaaaatcgtttggaaatatcgtgggatctggtattaagatattatttatctggttggaacacatatatatttgtatgtaggtttacattctatgtacatattatgttgagcagatgaaatggatgaaccataatagtatgtaaagaaaattttaaaagctatttgattaacagccatttctaatttaaaaacattttgtttcctatagttaaaaaattatcctctgctgctgctcctggggtttcttttattttttggctttatcacttaaagactattaaaatgggaaatgagtttctttcctattaaaagcctttaaagaaaatgatgctttaaaagaaagccaagacactaaacacctttgagcatttttctccatctcctaaatgctctgtaatttgtatgtaaagaatgtaagacctgtctgcctattttgcatggcattgctatttaatttttttatttttgtttgccgcaattgttatgggtaaatggtgagtgtgaggtaataagggcatgctatttgtgagaatggcaaaaatgtattgtttcatactacgaatgcatcttcagaataagtgggtggtctttcattgccacttaatgtgatttttaagggaaggcattcacagatacaaagacattcttcaaaatgtgatcactataagaccaagagcctcacaaataagcagagtaaaagactaagaatctcatacagtattgctaacaatgcgtagaggggaaataaaggaaggcctatttgccctggagagatgaggaagcaatccgaaattccttgattgcggtgtgaagactgttaacactttatacaacgtggaagagaaagaaggtaaagctaaggaatcctaaacaaggggtgaccttagagacgtgaggagaagcatgatgtgatgggaaggtagaaaccacaccccatgctacggagtattcaatcatctccattagcagtaattaatattcacacaacaggaaagaggaagacttttctttcttctattctcgcatttttctttcattttttctttcttttaaaaatttgtttgaattaagagataagtggatagtaacggttttctttaaaaccctttggcatgagaactgatgaaactttagggaaaaaaatacatgcctgttgaagttttagacttaagagagcatattggaagagatatttgaataaagaagatgctcatgtgttattttagaagagagttacgggagtaacctctagtaattgataagataaaagggtaactatacaaaaggaataatacagatagcttctgaaaaggtagaataaaacccactagcgacataaagccagaatgactaacaggaaatattaggtagtgaaatggctaacaatcttcataggtacttgtttaattctaatcataaccctcaacgtggattcagctaagaaatttatacttcaataaactccctggatacacatatattgtacattttatttggagacatattggtggacttgttcaattttgctaaaacattaaagttgatacctaatatagaagacagtgtcagtatattgacttccaccaaggggaaattattctttaatttgattgagatcaagagataaaggcgaaaaacttgcatgtaaaaaaaaaaacagatagtgtggtacacttttgagacaacagaaaactaaataaagaagagtgaaaggaatacaatcatctttagggaaggacatttcagttggaggaaatttcctgtaatttaaaatgtatggaattgcaacaagataaaaagtattacaatcaaagaatataaaaaattcaaactttgttcatgaggattttaacagtatccgtcggtatttgggaaataataagcataacaaaaatgtagattaatttttaatttccattaaaaagcatgttttcattgcattgaagacttaatataggacctggaaaaaatgagcttttatctggatagttatatttgaagtcaatactatcgccccaaagacttttaaacaaacacatgtcttctaaaggctttagtactgttttataatgtttgcacttttcttgttctccaggcagtgtttagtagttaggttttgtttcctttcaataattgaagcctagtgagggagacatgcctgtaactgagttctataacagaggcacacacaaattgccaggtaagcagagaggtaggagtcataattcaacttgtatgtctaaaaaatgaagtgaccagtgtcaaagattagcaagttatttgacccgattttattattagaaaggaatatagtaacttattcacagcagaggtagaggtcagaaagtttcacagctcttttaagtgttcattgtaacaaccttttcacaccactataattaggtgcttttgtgtacattgtcttttgctagacactacaaggagatatccatttggtgcttccaaatggaagaccaaagggtcttccttttggtgcttggcattttaaatgatgaaaatcaatgcacactcatggggttaggtaatagttgaacatattaatagatgaaaatgtacatatagttaatgtccatttacttttatctaaggaggatgaagtgggatagtaattagcagtcagtaggtgtggcatgtttttctctgtggaactgttaggcaaataatctaattcattcactctttttgtaagaattatccaatcagaaagttcaagataaaactaactgcctggaggagaaatgaaaattaaattgagactttcttgataaatgacagccttgattttacctgaatgcatggtcatagcaaagacctaaatagctacatgacttataatgagattgtatcattcctaataaccccacttagaatattacatttatttctggctaccatatgatacagtttggatgtttgtcccctccaaatctcatgtcaaaatgtgattctcaacactggaggggggtcctggtgggaggtgtttgggctgtgggggtagatccctcatgaatggtgtggtgccctacttatggtaatgagttcacatgagatttggttgttgagaagagtctgcgaccccacccccctttttgcttcccctcttgccatgtgacatgcctatttcccctttgccttccaccatgattataagcttctggaggcctcaccagaagcagatgatggcactatgtttcttgtacagcctatagaaatgtgagccaaataaacctctttcttttataaattacccagtctcgggtgttcctttataccaaagcaaaatggactaatgcaccatattttttttaaagatgcagcatttgaaagagagaattagattggccttaggatatgagctgtgaagacaggatagaatcctgagtttctgtgagttttaaagagcaaatttaagatttaattgaaaataatataaacatatcaatgtacatagagatagacaatgtctttttattatagtatagattattgtaaaagagatgcataaattttagaagaaaaacttgctgaaacaaacatcggagcttctcagcttttcaagaccatttttctgtagcatgcaaacagaataatgcactactgatttattctatgaatgaaaatgtctacaggatttttcagagagtgcttttctgaaacatagaagagaatgccccttagctgaatacctctaacaggcaggcaataactttaaatcagaggaaaaagggtatgtctcaggagtggcaactaaactgcaaccatcactgacctctcagaagactttcaatgtaatctacctatattgtaggcaggtagccaacaatttaggaatcagagaactacagggtttttgagctgtgatgggctggagagatcaactcattcaaccttggttttacagagaagtatactgggatctcgagaggggaagtaatttgctcatggtgacacggttaatggtgacacagttaatggcctagtcgggaccaatacccaagtttccttatgccttgttcagtgtttttctgttaaccctgttacgttcagaattggctgttgttcaaaagttggaaaataatttttcatggaaacaaagtcataagctcagagttctcctttgttccattctgtacttagtttccataagtcaggctttaaatcatattaatgttggctttagactttctgttgcacacgtcctttccttttgattttcatctccaccaccctgaagtaacctcctacttggtctcctcacctacacactctcttataacaatccattctgtgcatcttgtcagttttaatttcctaaagcattgttatcctctttcagtctttgttctttaaaacctacttcaagacccaagtcaaattttacctcccccatagtgactgcactgacgacttcaggtaaaagtgatattttcatcttataaattgttatagtacttaatttaatttcacccatggattcaacattcattaatcagatgtatttgagtatttactgtataccaggaaatcaagtggtgcttatcactcacagatattcaatgttacatttgtggtcataatttctctctttttagatcgtaatattcctgatgtaagatactatggttgaagatctttgtattctctttgtatcctccatagcacagagccttttgtacatagttgatgatcactaaacatttatagaataaatattgaactaagaatctgctatgataaggtgtgaagataaatatggcctctatgggatcagtatgcaaactgttagatatcaattataagcatgtttgaagagctttcgtcaatagtcaatatttttactttctttcttcttcttttttttttttttttgagacagggtttcactctgtcacccaggctggagtgcagtggtgcgatcatagctcactgcaggttgaaatacctgggctcaagcgatcctctcacctcagcctcctgagtatctaggactacatgcatgtgccaccatgctcagctaattacaaaaaaattctgcagagaaggggttgcgctagttgccaaggctggtcatgaactcctggtctcgagggattacggatgtaagccactatgctcagcctttttgattcttaagttaattctttgcagtgcataaaagtcacatagcttattaaggaaaaaagcatcaagataaaacagtaattcagtcatattcacatagataaatattaacaagaagtggtagaatactgaatcagattaaaaactcttcaatctcactttctacatatataattttaatgtatatattacatatgaaaatatatgaagattcaaacttacttttgcgcacaaaatagttttattctattaggcaatgaagagaaaatgctctgttaactgtaaaactatacaacaagtggtattattatttaaatatgagattttgaacctgtaaacaaacttatatatattgctttgaaagataataatttgtaattttaaatatgtgcctctggtctcttaattggtaaggaacatggattttattttattttaaaatagattttaaatagatttcaaaatacatttatttatcttattttgaaatattttattttagactattttaaaatattttattttaaaatccttgtcagggattaagtcaggagatgaatataagggatttaatggactttcaaatcggtaatcctcttcattcccatttttgactcccagtaatacattaagagcatgtccaggccaagattcctttgctctgaccctgcttgattgtcttcatctgcagctacactaaaccagataggattatcagaatgatcaattggcaaatgaactcattttcttagaaacagcttagctgagttctgcttacagaactgcttttcacatctaatttaagcttaattagaccaatttgccaaatgttagaaaaagttaaggtataattcaaataaatgttatagcattatttattttcatgaatagctttataatgaatctatatttttaccaatcaataattcagtatatttgctgccatcaataagtttggacttataaagtttctgataaactttggctactcagagaaagtttactcagattctagaacaccatggctgttcttatacaaatcatgtatcataattaattatgttaatcagcactgcaaagtagaaatacattctcaaaatatgttttataaaaataaccttaaagactgtacagtgatgattttgaataagggtaaagtgtcccttcacaaggtcaaaattcatctcagttgacaaatatttactgatgactactgcatgccagcattgtgtgggttgatggaatgaaacagcaaataaaaagcctaacctactatctcatggagtttacagtgtcattggaaaagtagacctaaaacaagtaaataggtaaaataattacacattgtgataagtgctaggaaggaaacatcattttaatgagcaattcagggttggaagttgacaccaagttctccacataggcagtaaactaggaagtaagccagtttactactgtctcagtgtgatatcaaaccatcaaacacaaagttagctaaaagctgataaagcagtaattgtgtccaacgttttaagggctgcagagtatatctaccataaatgttttgtttggcttctgaagcatttctttagtgttttctgtgagtcattctgaacacacaatagcaggacatgatcatcgactggaagacatgaaatataaatagtgtaatggtgctgaaaaatcccttaccggaggctggctagaacccctatgcagatcaaagcacacaattcaaaggtcacccatgatgtctagccaaacctacaaacatgaatagcaagactgaaagataaaaaatttccaacagaaacattgtagacaaagatgacatagcattaagtgatctaaaatttatgaaggttttgaggaattttaacgtttaaagctttatacgacagaaatgatttcaagcaaattagctaataatcagtttatgtatgtgactgatatttactgaatttgaatatgtggaagaatatcattgaaaatattagttggtatacatccatagtaccactaaagatatttaatgggcatcatgcttgatggtacatatattcatatatcacacatgttgaaacacttattgttgtaccatgagaagaccaagttattctattttttaaaatgaacattgccttgaaaaagatatttgatgctgtgaacagtaatcctatttttgatattctttgtttttgtaggacatatgagaaatatcattgaaactgctgaggctcctcggacaggaccaacaaaatattgtttgtataaaggatcatctgtcagagacaattgacatagggtcttgcattctttgagttatattgacactctatgttaatacaagagtgtatatatataaccaaaaaccctatctcctacaaacaaactagtaaaaaaattccataggcccatttatcttcaccaccaccccatcccatattcaattttttttgtttttcctcttgactctgactttaaatctcactgatttttaaaagactcaagtgtgtgcatcaaaatttatcagaagcagcaaatacttaatataaccaaagtttttgttattcccaaataattacagaaaaaaaattctgagaggaagcaaatggtcagttttaattgtctgggccttggttcaaaaaatcatgtgtttggagatttaacagacaaagcgtttgtttggatgcctcctacaaacttaaataggcctgaaatatacaggctattaaatttacatctttaaaataaggatatcctcaggtttttttttctgttaatatatatgtttgccaaacatttttcaggattcctaaagtgattaaatgcctttaaaccagctgctgtggagcaagtgttgttatataagatgcataaagttatcatctaagagtgaggaaagacctttaaaagttccaacagtggaaatgcaacagttaacatgatttggtcatatcttcaaagataacttttaaaagttttaccagcacatatttattggcagtttatctcctactgatgatgtctgatgggaggtggggaggcattgcttgacttatacttcatttatttattacattttgttagcaaatagacattgtttattgtattgggccagaaaaataaattgcatgactaaaagatattacctgtgtgaggggcaaccgaaacctaatttagtagtccccaaaatatggcagtatatgtcaacagctgacttcatttcaaagcatagggaacatttttatcgatcttttcgaattttaaatatatagcttctactctgaatgatattgtatctgtgagcgtaatcagaatttgtttcttatttaatctgtgtttatctgatgcaacttgctttaggtgctattctatatatatggatgtcaacttcaaaggtcaaagacttgtctttcttcattaataaaagtacatatgacttttttttaagtagacagatgatttagcactcttagtgcaccttcagtcaataccttacacacacatggaagttttcagaaatcccatactttctttagggaaattgattgatatttgggtaaattacacctataacccttaaaatagcagccataaaattcatattctgcctgggaccttggaaataacataaattcaacataaattcattaagagggccaggtataaggtcataagaaattgtgggaactgtggggaacagtagagtgcatgctctttctatggggtagccattgctaatctacttcatctagttgtgccaaaccagtaagaatgtgaaaccagtattgccagatctctctttttagtaaaaatttcaaccttattttagattcaggagtacattgttttagacttggggggtacgtgtgcaagtttgttacgtgggtatattgcgtgttgctgaggtttgaggtgtgaatgatcctgtcactcaggtagagagcatagtacctaatagggaatttttcagcccttgctcctctttcctctcccctacgtctagtagtccccagtgtctattgttgacatctttatgtccatgtgtacccagtgtttagctcccacttgtaagtgagaagatgcagtatatggttttccatccctgtgttaattctcttaggataatggcctccagctgcttccatgttgctgcaaaggacatgattttgttcttttttatggctgtgtaatattccatggtatacatataccacattttctttattcattccctgttgctaggcacttaggttgattccatgtctttgctattatgagtagtgctgtgatgaacatacaagttcatgtgtgtttttggtagaaaaatttattttcctttggtatgtgcccagtaatgagattgctgggtcaaatggtagttcttttttaagttctttgagaaatccccaaagtgctttccacagtggctgaactaatttacattcctaccaagagtgtataagcacattgaaattcagattttatgtaaactgttttgatttttaaagctctgtacagaaagatcactggcttagagatcaagggagccacaaatcttgtctcttctactatctaaatatatatgtaatgtttatcaaccttattatgtccccatgaggataaaacagatatgacagtctttgggaggacattaaagaagtggttctctaatatacaatagaggaaggaagcaggattaaaaatgtaggggcagtagctgtcattcaggtcggtatattgggtgatctgacactaacttcctctgcgactttggccaaataattgaacatctcgggagaatttcctcgtctgttaaatggtggtggtggtggtaggtggttaaccaaagcagttcaggcacccccattatatcacataggaaaaggaagagctgcactaatgaaaggatataagagaattgctccctttatttttccttctagtatacattagcagtttcactgaagttctttagaatccagtttgaaatccattgcagtagataattccaaaacttgactgtatctttaaaatgctctgtttgaagtactttcctttgtttgaagcatcggttaaaggaacaatctctttagtttacttcacatcagaggctgaacataatatgtgatattagatagtgatttttaaatttatcctaaaaggacctaaatacttaaattaaatgagcctgacattttaactggactccttattatgtggtattttattgcctcctgtcatgtgtctcgcatgctgtttctctatattattaaatgagattttgtggggtaaatttaggtttcaaaagtgagaatatcatatctctgattcttatactaaactgactgcaatcaaagatgagcatgctgggtagcaatcactgtcgttaactttgttgagcttcacattcacatgcccaaagttggaagaatcaaagtatgaaaatttatttatcagtgatacagggtaaaaatgaccttgactaattctaaataaaaccagctctcaattattaacttcttgggtctcagccagagtagaatcaccttctagtcataacttgtgcatatgggaaggctctctctacagtaaggttaatcaatgtcctaatgtggtacaatcatgatgatgattggaactagtgagttgtgtagagaaccctcactgcttaccaccatatgttgtaaaatctcagttgctaatagttctgttggtggtagttgtatattgtatattgtatctgccacaacgttcttgactgtgtgtaacccttgttttgttagtggctttataagaatgtgaacatatgttatgtcagccacaaagacacattttagtaaatttcaggcctcttcatcatgacttttgtttcacagccagaatcagaagtggagaggggcagcaaaaagaaaactttagtagacaaagaggaaatagaaggaatgcaaaacattttgggccaactccagggaacccagctgattttttttcacattataacctattctgtactgagctgataatattagtatcatcatctgcttgttcaataaagttttccaaaatgttgattatttggcaaagtataaggaaaactaaaatgagttaattgatatcactaaaagaacaaattcagaagtatagaagtcacattttacttagaatgtcaaaaacaaaatatacctatttaacttgtaggccttaaagccctggagttatagctagtttgttaagcactattgtaaagtacattccttacattggacaagataaatgagaaattttcaaatatcaaggtaaactcctaattttctgagtaagttttaaattgtaataaaaggacagttaactcatgggtgtttatatattcattgaataattctaacacgaatgtttctgtagtcagtgatttcagagtctaagtttaacctatgaaactcatgccataggagatgtaaatgattttgattttggtgaggattagtataattatatatatatttatatagtataattatatataatacatatataattatatataatacatatatatatatatacatatatatatgtatatatatatagtggtagccaaaaagtttgttgtgcttagaaagttttattgttaaaaaagagacggacctttggtaaaattgaaaaagtgccctcaaatccagtcatatatagcccattaaaataaggaaggatgcattatcactgacttggtgtgtatgattatattttatttaagaacagtgtcacctcagaagaggttgggtgagtgagatgtaaagcaaaatcaaatagttatggcagtggagtgacagaacgtaagagtaggtgaaaaaaggctcaccttcactcttacctcctctccccagcaaccccagatatattttcattttttttagaacgctctctacagactttgagcagagaaacagttgcttttcaaaagcaaacaaaacaaaacaaaacagatgatattttcatttttgttcaacaaaaagattatgaactaaccacatatacttgtagtgggcattataggaagattcccatttctgtattactaagaagtacattaagggttaaaagaaccacattatagtcctcacaggtttttttgcatgtcatttcagatttcactgttctttattaaaggattggagaacactgggagttactgcactgctggaaagaattattattttgttaacaaggctaattatgtgttttttaaaatggatctcttttgtatgtgtttaatttcttttgtgtggatgtatgtatgactgtgtgtgtgtgtatgtgtgtgtgtgtgtgtgtgtgtgtgtgtgtgaatgtgcatgtgtaacccttgtgaggaagatgtaagataattcagtatgctccagaaaaatgtatatagtgatctgtcggagatcaatggctccatgtttaggaaataagcacaacattgatattggcttactttcatcatcctgttggccaaataaaagatgagaaaaaattagaaagggatttttccctccaaaatgttggaatacctaatgggatgggaaggaaggctcttgagagagagggaaaagacataatattgctgaatttttttggaattgttacgacccaaggccactttcttcaacagaaatctataaccttatttccttgtcttcatatatggaaaagccctaaaccacatgacatttcacattattctttagtcaatggggattatactataaatgtgctaacattattcatatatttaaaacactaatagcaattcaggcttccttaccttctatgtgctcttccctgctggtgtttcattgtgtgtaacctatctaaaatttctgcagaatttaggaagatgttttgtgaaatataataaagccttgcttaattggaagctaactaaccagaactctcaattaaccagttttatttatttattttctgctacactctccttttagaaggaagaggcaaatgacaagaaaacaagctgttaacaggtatttatgtatttattttttaaaaatcaaattcctgagaatgtcctggagcctgtacagattcagccacactttcataatcttgttccctgtactatactcactaaggtaggaaagtagagccatttgaaattttcagcagcaaatgctgaatcttgcttaatcctcagttcattagaaaaaatgaaatccaaagagtgaattacaatctgtccatccagttggaggttataaagcagaagttagagaaaggctgcaaggttggttggggttgagtgaacaacactgacataaaaactttgacagctatgtaaaataatggggaagttattcagatgtccacctgcccctttgttctggaatgcttaggaaggtacattcacttttgcagggcagcacaggctattaagtgtgctacaacgataatggaaaagaatctggctttctaatcttctgagtcattctaagcattaggcacagatatgtgttgtaggcatgttagaagttctaaaacatttaaattgttttcttctaatattttaaacaaatatttggaagtctaagaagatttatacttgaaacctcttaaaatatctatgaaaatcttagtaaaagggcaatcagagataacatattgttccaggcctcagacattttaggttgtagtggtgaaaagaacacacagtgactcagagacaagggcaaaggaggggaacccatgatcctaaaatatattttgatagttcctgtcagtagtgcccctcttctcttccacacttctttctcaggttacattaacttttggtgatatttttttgcccctttctttagggctgcccttgatgcaggctttatccatatttttctataagaaaaacgtcatggagctgtaggggagatgaggactataccatggatttatcctgggttttcaacatacaaaataaaacatcactatggtggtgtttctagtatctgtgacattttctatattaaaagttagttttacatgtcatgcacactaaataatacccaagtgacctgaagcagtggatgtgcctccttaagtgccaaactttctattagacaatgatatcaatgctggggagactaaaacccactagattttattaatgactgagtttaactgtaaaatagtaaatggattatgttttgagtctaggcttggatattgaaagtgtttccgattttatatgaatgcaattgaattcaggcattgaaattggctttcactttatttttgattttctagtaaaatgacaagcaaattaagtcaagttctttcttcattaaatatagcagtaatttataactatatagatttatttctggattatcaaaacatacttttcatatgtacatatatatatataatatttttacatttattgcaatcagagaaaaaccatgaagtgtttttgaaagtatatgtatcaagtcactcacataaactatagagaaaccaggagagtcgcaaactccaatccctactgaggcaaggatggtaacgtaaatgaaagactataagaaatacagagtggtggggactatggtgaaccagggagtatatattcttttccaaagtggtggctgttactcagtttggctgattattaccatgtgggaatgcaggctcagtattgttaagatctgactttttaaaagaagctgggaattacgatttttacatgaaattctccaattcttaaatgttggtaactaactcaataaaaagcaaaacaaaacaaaaaaagcaacactgcacaggcaaaacaaaatccatctggggtcaggatatagcccatgggctgtcagtttgcgacctctgctctaaatggtgagtcctcaagatattgcaattgcaaaaagaatcacagtttgttataaatgcacctgaagcctttgatcatggaaaattcatataaggtgaataaataaccagtgggagtgcttacaaataattattctggtactcaaaatggtggttatgcgctttgtgggttttattttttactacttcaaaataggcaatatagtttttccttcaagtgatttgaaaattaaaattaaattagtatttttttgctttcctgttatcagtgaaatgcagtatgaaacagattattactgccatgtccacaaaagaatacttaagtatagttctcatcacataacataattaaggtttctatttaaagtccaatttattttgttttaataagaagaaagccatgtgtataacatgtgttgttttattttaaattggcttgcctttaaacaaattcccaattccatctagcaaaattcctttatttttacaaatggttaaaataagaaataaaagaaatgtaagcagttaacacaacaaaacttcatttgaacttttgataggcattggcaaagataaaacaaagttggtcatctgagattttattaaaaggtaactgtttgactgatctgagactttgcttgtttgtctgtcctgccatggaccttagcacataatcccactgtgctacaatgcttttgacatctgtatgcccctttcatcactggcaatccaaaagcatatttgtctaaaaaggaaacaattaaattccaatctctctaggaaaaaaaaaagaaagaaagaaaaagagaaagaaaacaccccactgttaaacctgctttaatggtcacaatgatttgtaccataaatccttattgaggatggtaaattaacattttcacttctgatgagaaagtcgagaactttaaaaagaaaagtaaaaaaagaaagagaaagaattgaaggcattatctcaaatcctaaataaactagaaaaaaatctcattccttgacaaatcattctagttgcagatttaacacaaacacacgtgaaagatgagaaattattgggtaactggtcaacacatatgacaatgtgcaaaatagctgatgtttacttaaataaaatttgggtagacagtgctgccctttccagatcatcagctagttttgaccacaagtaatctgttacatgattgggatgcaatatgtttaaatatactaatgaatgaaacttatttactaaaactctaataattaaggatctttagttaagtggttaatcctcaaaggtagagaatttaagaaatgagtgattatttgatgcatttgaccagcatagacatataaataagataattcaggataaaatattgatgaacaattaatcctctttttttgccaagacataataatatttaacatttatcaaacgtgagttcaggtgatttttcacatattagttcttttaatcatcgtaacaactctataagataggtgctgcaattataatcgttgtcttacagttggtgatactgagtcacacagatggttatatgatttacccaaggtcatacagcctataaataccagggacagcatttgaatcaaagcagtctagtttcaaagctcatatgctttgggccaatatattttataaccggccaaatggaatcagactaattagaaaaacacctcatttactattatatattaaatgacttattgaaaaatgacatttctattcagaaatcaagtttggtagcatcattttgatagtgtaataaattagcaagattataaaatagttcagataaagcaggaagaaaaaaataaggaaagagcaggaaatactgagaaaaacttgtggatcaatattcaggtctacattttgctacacttaatccacagtttaattttaaaaattgtatctgaaaaaaatttgtatctgtgaaacattaatattatgactaacaataatctcctttttactccacaaatgaaagatgaccactaatcctaaaatcagtgtgtatcattgctgtgtctttttaaaattatgtgtgtatttatacacaaacaacatgcaatgttgatttttgtgtttttttaattttttgttttaagatgtatcaaactgttgtgatatcatactattctttttaagtatttttacattatgtttttgagatttatccgtattgatatatgtaaatctagttcacttattttttaattgtccgttatactaccttgtataacacaatttgataattctttcctatattcataggttgataattaggttgtttccaattttttgttggaaaccgtgctgtaatggtcatgtcttgcacccatatgggagtatttctctaggatatcagcctagaagtgcaatttctaggttgtgggctatgtgtgtcttcaactttaatggttactgccaaattgttctccaaagctgttctgatttactctcctaccagcaatatacaagaggtcccatttcctcacattattgccagcgtagtagatatttttaatgaatgatctgtttgaagaaaaaataattctttttattctcttacgattatacacatacatatgaaatattgattccgatcacttagcacagataaaaatatttacagatactatttttgtcattattcttcatcttaaaacatatgtaattaagataaggattaaagatactattttaaatttgtaaagtatcgtctaagttacaagcactttcccataaactttcatttgatgagacagtatggtataacagcaagagctctggggaaaaaaagagtcataagtccatggacttaactctgcacataaatctgtggctttggacctcagttgctgcatcttttaagttacagtattagactaaacaatctcttagataaatagtatatgctttgatctatgatacgtatctttccttttccttgaagctgtaattcatttattgtgcataaaacataaggagaaaattgaatttggtcaatttgtgaaaattgttgtaacactctctctggctcagttaataagatcataactttaccatcattatacttacatttcttctaattcaaggacagttaggggtggatggtggaagagaagatgtgacacatgatttcgaattcatgttcagtttttcccatttcaaagcatcacattctaaatgctgaaataaaaaaacaaagaaagctcaacaactatttgttatgactttgtgtttgctttcaagctccttttatgcacatttctgattcagaagaaaatattcaagattttcagctcatttaatgtttgattccagcagtacttttatggtgctacacgtaactacttaaagcagagagaggactcaggttgacgactctatattctttctttcttttcttttcttttttttctaaggacacgagcccatgaaatagcctcaggaggtcctgagacacgtgccccctttatttctttttgaataagggggtaagtaattagattttgtgtttggagagagactttttatttgaaagatctggatctttatcctgaggtttaacacagaactttcagcttttcttagattctatgtgtatgggaaagaccactgagttagaaaccaaactgtctaatattacaggagattaaagtagaaaagggaatcagtagaaactgattttgtttaaactctcagagttgcaaatatgctacattcatacacacacacacacacacacacacacacacacacacacacacacgtcctcttgccagcacagaatatctgttattttcaatgacttttaaaaagaaaacttaacctgtgaggacattgaacactggttacgagtgaagcttctacttatggaaggtggcagttctggcaaacaaaatataaatcagttaatctcttgtgatgaagacattcttagagacctttctttctataagtagtcctgggaaaatgttttgactatagcattcctagaaagtgaattgacctcctacagagtttcaacaccaggtattacaagaaaattgtggttcacacactttgttcaaattatcttcagattaatacaatttgcatacatatacctaattgtccaaatgtaacaataagcctagagaatcccacgtaagttgctttgggcctgtttgttaacggactgtggggcccatatttaagatctttcattgctatttttgctaattgccatcctgtttttagtttaagcatactctggaaaccactattttattgcattgcttccactagttcagagaatcaaaatctctgccaagataatctacagtatttctgcccagatgctacctatcctatgtggagattcaactgggttagctaatttttttcataaacacgaaataaatcacttaaaacacaagctatctcaaaatctttaatacagtttcaaagatgtaggtcagaacattttcaagacaacacttcttggacatatttcaccaagtaactgacaagattattgggaaattagtactctcattaaaaaatatattgcagttgctcagtatttattaaaaaacaagaaaggaggaaatatgaacattgtcatatggcctttatcacctgcattattcagaaatgctatatgtatttgaggcgttgatacatctctattcgcaaaaccaattgcagtctttccttgaactactccctattgagtatccccacttttgttagtctgaacgaagccttggcaaacgaaacttgttatcttttatcagaaaaagtcaaaaccatggacacgtttgtcttgaccactgacttcaagaatacccatgtgctttgccaaggacggcatctagataataatactataatattactataaaatattttcttttattattgaaaacccagtttgaaccttgagcaagtcatttacatgctgtttctttgggattacctacattcttgtccactctgaccttgtaatatttctcacagttggaaatgtaatgcagagtgactaagataatgttgtttacacagactctaagtggagtgacattatagtcaagcaagtgtcacatcacccaatgtgaaggaagacttaattaccataatcctgtgaatactaaaatttcttagccacgtgtagcataataatgtaatgttttgcatgtacatttaataatgcaaaggtgtctcaggctgtgtgtttctttaaaaatgaaagcaaagtgggattacagaaagaaaatagacttttgaaattggaggatacttatctgaatgttcaggtgaagtctgtcgtttcttttaaactccaaagagttgcctagtgatgtgaaaatgaagggactgctgaaatatctataaatctatacaccaatgagtagggtgacagaccatgaatttctctggagggcacagggtagatgtaactaaatgactgagacaggataaagaggaaaggctcataaccacctattattgtgcaatggggaacatatcattaatttacaaaagagtggtgacattttctaaaattgtatagccctattcttaaaagtttgtcagtgtaactaattagtttctaaaatggagttgattctaagacccagtatgaatgcatttgaaaaggcaaggcattgtccctaaattggtagggtttgtaatacatcttgatgaatgctacaaaaataatgttaagaaataggactattatggtttgtagtccttgaaggaattatgttccatggcaacgtgccctaaagacatgtcctgctttctgtttttgataacactgagttttcaatacaaagaattcaattgctcaatgggttcttctcccagtgtatgaggactctaaagatcttttgttattttaggctatcattggaatttttgtttttaaactaatgttaatgttcaaaagagggcaagtataaaatgaatcagcaataaaatgtgaagttgttttaaaataaatccattagaaaggtgagatgtaaaaaatgtgtagctcaatcaatagatttatgtaagtgatattcataatttatgattcaaaatactgtatcatctgagacagtgttccagatgtttttaaaaatgtgcaaaagctgttaaaacatataaaacatcgaagcctgttaataacagcagccacgctttacaattaggagagtttaaaaagattgtgaactgatttatcattataaaatactcttccaatagagaatactttttctgaaatatataaacaacattttctttggttttcatttgaacatttttatttcaatttggacattttccttttagctggctagtcctagccaaacagtatgttagtgtaacatagtttgtcaacagatctgtattgttttgttgctttaaaatgaaactagtctaaattacaaaaatggtgacgttatatgctttatgctgcaagttttacaaatacccactaaatcacatattaatgtttctaacatattaggtataaagaaggtagtagtttttattttttatcatcaaatatacttggcattatagcacccactgtattcagaacattaagtgaagggatttggaacatctgattgacacatcccatttaaaaatggtgtatacatagaggcagccctccgtatccatggttctgcatccttggactgaaaatatttgaaaagaaaaacaatataaatagcaagacagcaatacaaacaaatacaaataaagattcagtatacaacaatttacatagcatctacattgtattaggtattataagtaatttagagatgaattagagcatatagaaggatgggcacaggttaaatgcaaatactatgtcattttacataagggacttgagcatccatagatttttgtatctttgggggtcctggaaccaatccccctgggatatcgagtgatgactatattttactttttagtagcattaaaatcacattgtgctttccatagtttatgaatgtccagctctctgtcttcaaaaatcactctgaattttggaactaaattagatacaattaatgtagggtaaaacactttttaataaccttgggttcagcacagaagtggttaaaggaagtgtgtgtgtttttaaatacgcttttatttttaggacagttttaaaaataaaatacagaaagaaagcaaatactgcactgagagttcccattcaccccgtagccagtttcctctgttgttaacatcttacaattacagaatcagtttgtcctaactaatgaaccagtattgacacactgttaactaagtttatactttactcatatttcttcagcttttctctaatgttcttttctgttccaaaatgtaggacatcacactttatttaatccgcgggtctcttaaagctcctctcagctgtaacggtttctctccttgttttcaatgaccttgatagttttgaggagtagtggtcaggtatttgtaggatgtccctcaactggggttcacctgatgcttttttcatgattaaattggggttatgtgtttttgggggaaagaccccagaggcaaaatgccattttcatcatatcatgtaaagggtatatactattgttttttattactgttgagattgaccttgatcacggggctcaggaagtatctgtcaggtttttctattgtaaagtttactctctttctttttttttctttctttctatattatactctttagcagtctttggaaagcactcactgtgcaaaattatttggaattcttctaaatgagagatttgccttttctgtcccatttatgtatttattcaattacttatttatatcagcatagacttctaggtgtttattttatactttgggttataatccagtactacaatatttattttattgcttaaattgtttcagctttggccattgggaactctttcagtaggctcctgcgtacctttgacatgcccccaacattgtggattttttcatacacttccttactttcttgcactggatgttccagactcatcttgtatatttcctgctccagtcctggagtcagaaaccatttcttcaagttgtggttaggagaatttttgatctgctcaatcctaagaaagtgctaaaggtggccaaaaaagagggccagagagtctctcttggtttcattttcttgtttgtctcctaaattttccatcatcctagtaatgcacataagtcttattctctcaccatatgaatttgcccattactcttataacatccagcagcaagaaaagaatgaaaagcctcatagtcttctacagtcacacaccttaattttcatgcataggtttagaaatatgctatgtaactccaagatacatgtcctacctgaaacctatccccttatccagcatcccaatacactacttaatcttcagtttgtgagtcactctgggatcattttatttttctcagagagggtttggggtcaaataaatttgggaaatatgggattaaataaaggtaaacaaacttggttactgcaggtcttcttggagcctataatttgttaatttgctttgtgattctataggaaaatatattatatagaagattttccagtcttttttgattaaagtagctttttgttctggaaactagtattccataaaatgcactttaggaaatgccatacgagtggtaaaaggctggaatttgtctttggaaatcttgtgttcagtccctcactggaccatctactagctctatgatcacaagcaaatcacttaacatctagaagtctctatttttttaatccataaaatgaacctaggaatttctcttccagggttgttatgaaaagcaaaaatgagtaaaaccaaaacttataagaattctttgaaaatgcataattcaatgcaaatttcctaagcactgtaaaggtcgggaccatccctttgttttgctaaccattgtctctttagtatctagcatattttcctggcatttaggtttcaatattcaataaatatttactgagccattgaattatattactaacacttacattattttctatttctcaccaagtatcgtatagcagcttatgacattttataaattactttttgatattagaagtccatgtaacaaaatgcaggcagaaacatacagttgaaatggctatatatgcaaaaaaagcccccaaacttttgattctagcctttgttttgctgagcatgtgctcccagccaatggctggctgcattctgattagttttcattgcttcaagctgaccagattttcctttgaaataagggcactgaagctttcaccttaattctgtggtgatgtaaaattcctgctgcagtcactgagctggtgctagaagaagaggagcacctgtgagcacaggctgtcaggaggcccttggagccctagagtgttgaggctacagctgctgggttgagaagcagttggaagcgctttgtcactccttcttgtgcaaccacaggagatccactaaaggatttttactttctttggatgtacaatttgtgctatcaggagttatggaaaggatctcttttataaaattgaagacagagtgaagctttgatgggggtggcaagttaggccctgttaagcaatatattttggtgagaatagtttggagatagtaatagggccctcatgtctcccattttgcccagttccccacaaaccaatgtattctgtacgtattcccagaggtaaacttttcagtttctagcttctctttacagagaatcaactggagcatgtttattgtatttgaatgtgagaagttgtcagcctccctggaaatgctacgttaatatttgaagtccaggaagaaccatgtagctttggaaactgcaaaaatatttcaatcaaattctaggctttgggattagtgagacaatggtcaagatcagtttagggggtctttcctttcttaatatttaaatcagaattatatatactagcatacctttgtccattatgtaattcatgaatgctagaaaacagaaatgttttagttaaaaaaactctgtatgggataatggtggcctaacattttccacaggtgttggtcggagtcagaaattctctaatgatagttaattttatggcattgctgttattcacactctgaaatagcaattttctccccatctgtatctctcttgctcaaaaaatacagactttaaggcttatataaaatatgtgtttcggtgagaaagggagggcttaatattagactatacagtactatgactttactgccttatggatttattattattccctgaccccacacctgaaactactgctttctttcaaaagctagactactcattcgtagtatcaactggtactttcatttaaattattcactacagttttccaccaaatatcttagttctttatttgattgaaatgaatagatggacactcttgcaagtatgttcttgacaattttgcaactttattaggtaaaatataaccatcttcttttaaatgatcagttatgggaaggagttttaagggaatatttcaaacttaatccataaattacatttaggaatctttccttgcactttacaaatttattgagtttactgaacttgtagcagcacagctaaattccagcaactgcaaaaataattagtgacattaagttgaaaatgttgtaaacaagtgaagttattattcattctgtaccacactacaaatgtgggaggacaagttaaatgataaattaggcatgaactgctttaatctgtaaactgaacatgttagcaaatggcttgcgtttgtaattagtatttatggccacaggagagtgcctctttaaaaacagtgacagaaaattgatcagtttaggtcgtcatagcaaccaaaaagtcccattgcttctgttaggtttaggttattatgctatatactcatgcttagaaatatatttatgaactgtaaagataaacgataaactacttaataatgtaaaagaggttgggatgccgaaatgccaaactgacaaagtccaaatgaataccgaattactcgataacgagcttaagtgttctgcggttgtcatgacatttcttttacaaagcaaatgatgctggaaaaaaaatcttaaaactagactaaaatgcaaatccttttatgacagtatgtggttgtcacgttcataataacagacaataattgatgatttataagatgacaccatggcaacagagtctttcatcattggcaccccttggttacttttatattagacgcttgaggatgcctgtgaaaagtttccaagatgacatacaagaagatctactcttattagctctcgtttaaaacagggtggaagcattgtcgagattttggaatcacctgacaaaataaaagctggcaatgtctctggttaaaaaaaaacatctctgctaaactaatttattcccatgtaagcacattcagtagctaaaattggacagatttgttttggtcacttaacctttcaaagaaagtctgtaatgcctctcaaatttgagtgtaagctgttaggttgtttaaaattatggtgaatgataatatccttatacaggaggcgggagaaggggagagggagtgcaggaaaccttgaccttgcttttaactcctaaaaagatgattttaaaaacagaattttagtgttgaggactttatgaaagtggaataaatttgtaattagatattctaatttatcccatttaatgtatttggtaggctgaggagtaaaatgttggaatttcttagaagcaataatctaatcagtttttcaattatagattattattattttttcttttttgagagagtcttactctgtcacccaggctggagtacagtgatgcgatctcagctcactgcaacctccgcctctcaggttcaagcgattctgctgcctcagcctccggggtagtcgagattacaggcatgcaccaccacacctggctaatttttgtatttttagttaagacggggtttcaccatattgaccaggctggtcttgaacttctgacctcaagtaatctgcccacctcggcttcccaaagtgctgggattacggatgtgagccaccatgcccgattatagggtatttaaaatataggaaatatagtaaacctcctctcttggttttattgtcagtttatgaaaaaataaaattctttaatatttggagcttttgaaaggtttcttggcccggtgcagtggctcatgcctgtaatcccagcactttgggaggctaaggcgggtggatcacctgaggtcaggagttggagaccagcctggccaacatggtgaaactccgtctctactaaaaatacaaaaagttagccaggtgtggtggtacatgcctgtaatcccagctactaggagacggaggcatgagaatcacttaaacccagcaggcagaggttgcagtgagctgagatcatgccagtgcaccactcgggctgggtgacagagtgaggctctgtcttaaaaaaaaaaaaaaaaaaaaaaaaaaaaaaaaaaaaaaaagactggtttctcgattattcagtcacttatttgattgaaccaaaagtctagacaatacgttttgaggttctttccagtggaattgtactataatttataaggggttgtagaaacaccaactatttgaaatattgaatataaaatactgaaactaccacatttaaatgacataagtggaatataaccatgtacatcaaagttaacctcgtctttctacatgaggttttaaaaaatacggctttgaggatttttctaaacacttatttcttacataatttaagcttttgtaaggataaaaatccatagtactcatttccttacgaacatcacataaccaattacataaagtaggatctctggtcatactttttattgatacattccctacaaagtggtgtaagggatataaaatccttaatttaggagccccaactattctttgatgcaaagaatcagcaaaatttgttcctagttaacagttaagaaaatggggtttaccattaaatgtaagaatgatttacctttacttatataagaaaataagttgtttaattctgaatcttattctagatcgtgggtaaatcacacaatggaacatgattttttttgcactagacactaataatttatttttcattttttaaatagtttgcaatttttttttattatacattaagttctgagatacatgtgcagaacgggggcaggtttgttacataagtatgcatatttttcattttctttattaaagaaaacatgttttctccaacattttgctataatggatgtttcaatgattaattttatatttgttttcctatctacttccattatggagttctattagaataattgcttagttgaagggtataaacatccattttgatacataatgcttgattctgaatttgattaaaatgatacctgttcttggcaaacattttactctgtgatgtataaaatgtataacatgtagaacatattgtttctgttttctaggagtttataatttagtccacaaagataccaactatgagcctgaataaaccataaaataatcccaaagtactaaataaagaaagggtgatattgtatgatatatagactacagacataagaattaaaattactcaattactcgtggtaagagaaaaagttaggctgaaatggttttgtggaggataataagtcaggacataagattatccaaatttagaacttaagtcaatttgggagatttgaatcatcagaaaactgttactctagattttaagagcccacatgaccaaaggcaaagagctagaaataattatggcatatgatgggaatactaaagaacactttcccacttacactgaaatggtatgactgcagaacaagaaaaataacacttagatattgcttactcacctgatttgcttctctgtctccattcttgactaatcttgagaattagtccttccttaacagtgctacacacgctgcccctcttgctcttagaataaagttaaaatatcttaacatagcttacaaggtcctatgccagtggttctcaaccagaggtgatttttgctcctatgggacatttggcaatgtttggaggcctttttggctgtcgcaatgggtggtggtggtgctatggcatctagtgggtagcagtcaggaatgctaataaatatcctataatgcacagtacagttcccataaagtggagaattatccagcctaagatgtcaatagtgctgaggttgagaaaaataagaaatgctaccctgtagcattttatctaacccctgcccaccttgttaatcttttaaatcttaagctactttctccctactcattatcaattcaattaccttggtgtccttgaacattccattttctctctcacattcagaatttcacatatgctgtctctctacctgaaacacacttctgttccccttctccccatacctcagcccttcatcttgctaaatctactcatcattctatatatgcctatcaactagattctttgattacgtgagtcatgctttatccatcattgtattcccattgctcagcatgttgtttgagacataataaatgcatgttaacgcaatacatagattactggagagtttcaatgctaagataaacaaaggtggttaagggtttgggtgattatgtaaaatggctgtggtaataaagagaataaagtaactttgagagaaactgcaaaggcagaactcccatggcttggtcactgattcgatgtggattgtgacagaagagttaaagatgatttctacataccaggtaaactgagggaatgggtatagaaattgtagaattgggaaggaatctttattttgaggtatcagataatgggaatctatttttatttacttggtgatgcctataagcagctagaaatagagtttaatttgggtgaacttgatatttctgtaactgtgggaaagcaatttaacttcagtctcttcatttgtaaaatggagaaagaatgagtacctacctgactgggtgggattaagtgagttaacacatataaaacacttatctttatcccagtgttggacatagaattaacacttaataaatggtagctattttattattattattattattattattattttcatcattataaatgtcttttttttcctttgtctctgcattttgaaattatacctttcagtacagctaccgctctcccatgaaactttttatgatgtttcagggtatcaatgatcaccttcctcccctgtaactgtatagcattctacattaactacttttttttgtacttgtcatgtactgcctagtcccatgattgcatacgtgtttacgttatgatccctgttatattgtaagttctattagggtaagactctggcttactcatcttttcctgacatacagtaagtgctaaataaatattagtttatgataattaattataattttattattgtcattggaaagtcatcaacagaggtattatagttgactcagaattaatatgccttccaatttatattcagtattaatgctcctagtattttcaaagaatatcaattgttttatgaaatagaacaaaatatcattttaaattaagtgctaagtaatctgaaaaatttaaaatgtatttaattgatgctagtcaagtttcattattatagaaaagcctacctgataaaagagtatttcttttgaaaaatttgatattttcaagttgctaactaatagtgaaagatcttttgcttataagctatgaaagaatatttttgtttgtaatgccaaacctttgaagaaactgggatattaaacaatcttatgaaaatggtaaagatttttaaaaatgaaataagcaatatcatgcatttgtaagactgtatatcctttctgaattcctttaagatataatatataaaacatcatgtcggtaaagtgttcagaaccaagtttaggaaatatagcccagggtgtctgaagagttttgtagtcacaataaataacacaagaactttgatatgagacattcttacttgtcttttgcacacaatttactttgattcatcaactcaataaagtgctctgtgcgtaggaaagtgttttatatttgcaatttatttatttacatggccgtcatccctactcgggccaatcttctattgctatcgatgtgtttggaactgccattggaaacaactgagactctaagtgcacatcttagggaaacattttgtctttggttgagatatgtaaaaagggcagtatcataaacgaatcttaactgaaaggttacatgaacatcctctctgatttataatgatgatctctaacatatagccccatttggatgaaataattttctaatgtattacagtattttcttctaagcaatttcactctctcataaaagtagatcctttccaagtgttcagtagctttagtaaaattgtacataattaatgaagttattttagtcatttgggataaattatgtgatacaacaaactatttgttatatatattatatttcttttttatttttattttattattattatactttaagtttcagggtacatgtgcacaacgtgcaggtttgttacatatgcatacatgtgcgatgttggtgtgctgcacccattaactcatcatttagcattagatatatctcctaatgctatccttccttcctccccccaccccacaacagtccccagtgtgtgatgttccccttcctgtgtccaagtgttctcattgttcaattcccacctatgagtgagaacatgcggtgtttggttttttgtccttgcgatagtttgctgagaatgatggtttccagcttcatccatgtccctacaaaggacatgaacttatcactttttatggctgcatagtattccatggtgtatatgtgccacattttgttaacccagtctatcattgttggacatttgggttggttccaagtctttgctattgtgaatagtgtggcaataaacatacgtgtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctattcgtccacatcctctccagcacctgttgtttcctgactttttaatgattgccattctaactggtgtgagatggtatctcattgtggttttgatttgcatttctccgatggccagtgatgatgaggattttttcatgtgttttttggctgcataaatgtcttcttttgagaagtgtctgttcatgtccttcgcccgctttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaataggggatcctttccccgttgcttgtttttctcaggtttgtcaaagatcagatagttgcagatatgtggcattatttctgagggctctgttctgttccattggtctatatctctgttttggtaccagtaccatactgttttggttactgtagccttgtagtatagtttgaagtcaggtagtgtgatgcctccagctttgttcttttggcttaggattgacttggcaatgcgggctcttttttggttccatatgaactttaaagtagtttatttccaattctgtgaagaaagtcattggtagcttgatggggatggcattgaatctgtaaatgaccttgggcagtatggccattttcacgatattgattcttcctacccgtgagcatggaatggtcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgtttttggtgtataaaaatgctagtgatttttgcacattgattttgcatcctgagactttgctgaagttgcttatcagcttaaggagattttgggctgagacgatggggttttctagatatacaatcacgtcatctgcaaacagggacaatttgacttcctcttttcctaattgaatgccctttattttcttctcttgcctaattgccctggccagaacttccaacactatggtgaataggagtggtgagagagggcatccctgtcttgtgccagttttcaaagggaatgcttccagtttttgtccattcagtatgatattggctgtgggtttgtcatagataggtcttattattttgagatacgtcccatcaatacctaatttactgagagtgtttagcatgaagggttgttgaattttgtcaaaggccttttctgcatctattgaggtaatcatgtggtttttgtctttggttctgtttatatgctggattacatttattgattttcctatgttgaaccagccttgcatcccagggatgaagcccacttgatcatggtgaataagctttttgatgtgttgctggattcggtttgccatattatattgaggatttttgcatcaatgttcatcaaggatattggtctaaaattctcttttttggttgtgtctctgccaggctttggtatcagggtgatgctgtcctcataaaatgagttagggaggattccctctttttctattgattggaatagtttcagaaggaatggtaccagctcctccttttacctctggtagaattcggctgtgaatccatctggtcctggactttttggttggtaagctattaattattgcctcaaattcagagcctgttattggtctattcagagattcaacttcttcctggtttagtcttcggatggtgtatgtgtcgaggaatttatccatttctcctagattttctagtttatttgtgtagagatgtttatagtattctctgatggtagtttgtatttctgtgggatcggtggtgatatcccctttgtcattttttattgcatctatttgattcttctctcttttcttctttattagtcttgctaggggtctatcaattttgttgatcttttcaaaaaaccagctcctggattcattgattttttgaagggtttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcctgtgggcatttaatgctataaatttccctctacacactgctttgaatgtgtcccagagattctggtatgttgtgtctttgttctcgttagtttcaaagaatatctttatttctgccttcatttcgttatgtacccagtggttattcaggggcaggttgttcagtttccatgtagttgtgtagttttgagtgagtttcttaatcctgagttctagtttgattgcacagtcatctgagagacagtttgttacaatttctgttcttttacatttgctgaggagtgctttacttccaactatgtggtcaattttggaataggtgtggtgctgaaaagaatgtatattctgttgatttggggtggagatttctgtggatgtctattaggtccacttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttatgaatctcggtcctcctgtattgggtgcatatatatttaggatagttcttcatgttgaattaatccctgtaccattatgtaatgcccttctttgtctcttttgatctttgttggtttaaagtctgttttatcagagactaggattgcaacccctgcctttttttgttttccatttgcttggtagatcttcctccatccctttattttgagcctatgtatgtctctgcacatgagatgagtttcctgaatacagcacactgatgggtcttgactctttatccagtttgccagtctgtgtcttttaattggagcatttagcccatttacatttaaggttagtactgttatgtgtgaatttgatcctttcattatgatgttaactggttattttgctcgttagttgatgcagtttcttcctagccttgatggtctttacaatttggcatgtttttgcagtggccggtaccagttgttcctttccatgtttagtgcttccttcaggagctcttttagggcaggtctggtgtgacagaatctctcagcatttgcttgtctgtaaaggattttatttctctttcacttatgaagcttcgtttggctggatatgaaattctgggttgaaaattcttttctttaagaatgttgaatattggcccccactctcttctggcttgtagagtttctgctgagagatcagctgttagtctgatgggctttcctttgtgggtaaccagacctttctctctggctgcccttaacattttttccttcatttcaactttggtgaatctgacaattatgtgtcttggacttgctgttcttctggagtatgtttgtggcgttctctgtgtttcctgaatttgagtgttggcctgccttgctagattggggaagttctcctggataatatcctgcagagtgttttccaacttggttccattctccctgtcactttcaggtacaccaatcagatgtagatttggtcttttcacatagtcccatatttcttggaggctttgttcatttctttttattcttttttctctaaacttcccttcatgcttcatttcattcatttcatcttccatcactgataccctttcttccagttgatcgcatcggctactgaggcttgtgcattcatcacgtaattctcatgccgtggttttcagctctatcaggtcctttaaggacttctctacattggttattctagttatccattcgtctagtttttttttcaaagtttttaacttttttgcgattggttcaaacttcctcctttagctcggagtagtttgatcttctgaagccttctctcaacttgtcaaagtcattctctgtccagctttattccattgctagtgaggagctgcgttcctttggaggaggagaggcgctctgagttttatcatttccagtttttctgctctgttttttccccatctttgtggttttatctacctttggtctttgatgatggtgacgtacagatgggtttttggtgtggatgtcctttctctttgttagtttttcttctaacagtcaggaccctcagctgcaggtctgttggagtttgctggaggtccactccagaccctgtttgcctgggtatcagcagcagtttctgcagaacagcggatattggtgaaccgcaaatgctgctgcctgatcgttcctctggatgttttgtctcagaggagtaccttgccgtgtgaggtgtcagtctgcccctactggggggtgcctcctagttaggctactcgggggtcagggacccacttgaggaggcaatctgccctttctgagatctcaagctgtgtgctggcagaagcactactctcttcaaagctgtcagacagggacatttaagtatgcagagattattactgtcttttgtttgtcggtgccctgcacccagaggtggagcctacagaggcaggcaggcctccttgagctgtggtggactccacacagtttgagcttcctggccactttgtttacctactcaagcctgggcaatggcaggcgctcctcccccagcctcgctactgccttgcagtttgatctcagactgctgtgctagcaatgattgaggctccgtgggtgtaggaccctccaagccaggtgcaggatataatctcctggtgtgccatttgttaagcccgttggaaaagcacagtattagggtgggagtgacccgattttccaggtgccatctgtcacccctttctttgactaggaaagggaattccacgaccccttgcacttcccgggtgaggtgatgccttgccctgcttcggcttatgcacggtgcactgcacccactgtcctgcacccactgtccggcactccccagtgagatgaacccggtacctcagttggaaatgcagaaatcacccgtcttctgtgtcgctcacgctgggagctgtagactggagctgttcctatttggccatcttggctccacctatatattatatttcaaatgaaattaatggttgctttaaaaactgaaagaatggagtttcttggcttttgcataaataggcaaaagtggcatgagaatatttattacattattcatgaacatgtatcaacaagcagttacatttaactggctaacaggtaagtgaaaggtagttaaacaagtgagacagtgacaaaaaaaaaaagaaaaaaaaaaaacttcagattaatgccccgatgaacatagatgaaagaaatcctcaacaaaatactagtaaattgaatttggcagcacatcaaaaagttaatttaccacaataaggtaggctttattcccaggatgcaatgttggttcaacatatacacatcaagaaatgtgattcaccacagaaacagaattaaacacaaaaactatatgatcatatcaatagatgcacaaaaagctttagataaaatccaacattactttgtgatgaaaaccctcaacagtctaggcattgaaggggcatatctaaaaataaaagtgccgtctatgacaaacccacaggcagtatcatactgaataaggaaaagctgtaagtgttccctttgagaaccagaaaaagacaaagatgcccactctcattacttctattcaacatagtggcggaggttttaaccagaacaatcagacaagagaaagaaacaaaatctatccaaataggaaaagaagaaatcaaactatctcccttcacttatgatataattttatacattgaaaactctaaagagtctgctaaaaggctcctagaactgataaacaacttaagtgtcaggatacaaattcagtttactaaaatcaataggatttctatacatcaataacttccaggctgagagtcaaatcaggaacatgatcccattttcagtagtcacaaagaaaatgaaatacctaggaatacaggtgaccaaggaggtgtaatatctctacaaggagaaatacaagacattgctgaaataaatgagaaatgacacaaataaatgagaaatattccatactcatggaatggaagtatcagtgtcattaaaagggtcatagtgcccaaggaaatgtacagattccatgccattcctatcaagctaccaacatcatttttcacacaattagaaagatttagtctacaattcatatagaaccaaataaaaagagcccaaatagtcaaagcaatcctgagcaaaaagaacaaaaccagagacatcatacaacctgactttaaactgttctttaaggctacagtaaccaaaaaaagcaatgtattgttacaaaaacagccatattgacaaatggtatggaacagaaaactaagaaataaatccacacacctacaaccatctgatctttttaaggctgacaaaaataagcaaaggggaaaggacttcctatccaataaatgacactgggataactggctagccatatgtagaaggatgaaactagaggcctaaattttaccatatacaaaaattaactgaagatggatcaaagatttaaatgtaatacctcaaactattaaaaaattctagaagaagtcctaggaaatacatttcttaacattggccttggcaaaaaactttgactaagtcctcaaaagccattgcaacacaaacaaaaattgagaaatgggacctaattaaactaaagagcttctgcacagcaaaagaaattttcatcagagtaaacaggcaaactacagaatgggagaaagtattcacaaactatgcatctgtcaaaggtctaatatacagaatctatcaggatcttaagtcaacagacaaaaaccaaaaaacttcattaaaaaatggacaaaggacatgaacagacacttctcaagaagagtcataaaattggacaatgaaaatatgaaaaaatcactaatcatcagagaagtgcaaatcaaaaccacaataagataccatttcacatcagtcagaatggctattactaaagtgtcaaaaacaaaagaaaacaaaacaaaacagaaatagatgctggtcaggctgtggagaagagggaacacttatgcactgtgggaatgtaaatcagttcagccactgggaaaaatagtttggagatttctcaaagaatttaaatcagatctaccatttggcccagcagttccattactgtgtatatactcaaaagaaaataaatcattctgccagaaagacacatgcacacacttgttcatagtaatactattcacaatagcaaaaccatggtgtattagtctgttttcactctgctataaggagatacccaagactgggtaatttataaaggaaagatgtttaattgactcacacttctgtagggcttgggaggactcaggagacttacattcatggtagaaggggaaggtgacacatccttcttcacatggtggcagcaaggagaagtgcagagcaaagtgggggcaaagtttttttttttttaaagcaccagatctcatgaaaactcactcactatcattagaacagcatggagtaactacccccgtgattcaataacctcccactgggtccctttcacaacacgttgggattatgggaactaccattcaagatgagatttttgtggggacacaaccaaaccatatcatcccacccctggcccctcccaaatctcatgtcctcacaattcaaaacacaatcatgcccttccaacagtcccccagagtcttaactcattccagcattaactcaaaagtccaagtccaaagtttcatctgagacaaggcaaggcccctccacctatgagcctgtttaatgaaaagcaagttatttacttcctagatacaatgagggtacaggcattgggtaaataaacccattccaaatgggaggaattggccaaaacaaagagcctacaggccccatgcaagtccaaaatccaatagggcagtcatttaaccttaaagttccaaaattatctccctggactccactccatgtctcacatccaggttatgctgatgcaagaggtgggctcccatggactttggcagctgtgcctctgtggctttgcaggatacaaccctgcttctggctgctttcactgctggcattgagtgtctatgggttttccaggtgcacgatgcaagctgttgttggatctaacgttctgggatctggagaatggtgtccctcttctcaagctccactagtcagtgcccctgtggaaactctgtgtgggggctccaaccccacatttcctttctgcactgccctagcagagggtctccatgagggttccatccctgcgtagacttctgcctggatatccaggcatttccttacatccttgaaaatctatttggaggattccagatctcagtttttgacttctgcacatccataggctcaacaccatgtggaagccaccaaggcttggggcttgcaccctctgaagcagcagcctgagctctacgttgtccccttttagccacagccatggcttgagcagttgtgatgcagggtgcaaattcccaaggctgcacatggcaggggttccctggacctggcccaggtgaccatttttccctcctaggtcttggggtctgtgattggaggagctgctatgaatgtctctgacatgccctggagatattttccccattgtcttggtgattaacatttgccttctggctacttatgcaatgggcttgaatttctccccagaaaataggtttttcttgtctaacacatcatcaggctgcaaattttccaaacttttacactctgcttcctcttgaatgctttgctgcttagaaatgtcttcctgcatataccctaaattatctctctcaagttcaaagttctacagatctttggggcaggagtaaaatacggccagtctcttttcataggaagaatgacccttactctagttcccaacaagcttttcatctccatctgagaccaactcagcctgaaccttattgtgcatatcactatcagcattttggtcaaagccattcaacaagtctctaggacgtccaaactttcccacatcttcctgttttctgagctctccaattctctaggaagttccaaactttcccacatttccctgtcttcttctgacccctcaaaactgttccaacctctgcctgttacccagttccaaaatcacttccacatttttgggtatctttacattggcaccccactacctgctaccaatttactgttttagtttgtcctcacactgctataagtacatactcaagactgggtaatttataaagtaaggaggtttaattgattcacagttccagaggtctggggaggcctcaggaaacatacaatcatggtggaaggggaaacaaacacgtcctaattcacatggtggtggcggcaaggagaagtgaggagcaatgggtggggaacccccttatgaaaccatcagatctcatgataactcacttactatcatgagaagagcatggaggaaactgcccaatgattcaattacctcccactgggcccctcccatgacacatggggattgtgggaactacaattcaagatgagatttggtttgggacacggccaaatcatatcatattgaattaatctacatgcctatcagtggcagacttgataagaaaaaatagtacatatgcacagtgcaatactatgtagtcatgaaaaagaatgagatcatgtcctttgtagtaacatggatggatctggaggccattatcctacacaaactaagagaggaacagaaaactaaatatcacatattttcacttataaatgggagctaaatattcagtagtcctcgacataaagatggcatcaatagacagtggggactactagagtggggaattagggaggttgaaaaactacctcttgagtactatgtccactacctgggtgatgttatctgttccccaagcctcagcatcacatcatgcattatagccatttaacaaagctgcacatattcaccctgaatctaaaatgaaagttgaaattagaaaagagaaagaagtttgttagaggtgttgctagttaaactgacatggttttagtttatattgacatgcttaagacagagacataattggatgttagttcagaaatgctaagatatgtccagaacatatgggagaatgactgatccctacagcaagctttgaactgagtgctggaaaaaatgtattccacagtttcactttctaacagcagaaacagaatatgcatgcttattttccaagtttctgctgagagtgcacctcctcatatatgtcttctggtccaggatctaaagaatattcttagatctaaatttaaaaatacatattacaagttaattatttcagtttgctttaaatccaaagaaatttaaaacctaaaatgaaaatgggagggaaaatgcatgcaaagaaactaatgaagcaatcatgtaggaattagtgtcagaccaaattatttcattttattttttgcttttctgggaaactaaagtaaagctgcataaacacagagacttgaactaacatgatttggtctgaaaagttttagttaacataaaaatgcaataatcaaataaaacagtgaactcatgaagaatattgagaacctattataatttcaaggaataaagcctggaagtttggaaatctaattgaatgaacatgataaacttggatttatatccccacaactgccagtttctctgtgaccttttgccagttatatagtcttgttgagccttcattttcttatttatagaaaaggatactaatattacctacactgttacttttttatgagaagatataatacatgtaaatgacctatccctcaatactcagtcaataaagcgtggcttttcttatcactcagaatctttaaattttaaacaactctctgattacaagccaggcacgattagtacagacaaaagctttgaggagagagcgagatcactgtggaccagcatactttgtgactccatgaacaaagaaatggcattttgcttttattgaattttgaactgtattctgttgctaaagaatggggaagagcttctaaatggagataatccatacccaaccatacggagatagaaaggctgatgagttttgataagtcagtgatgcagatttttttaaggcctagaggcccaaagatttaaaagcatgggggttacatgtgagaaggataggcagagcattgaatttcatggatagagtatgattttgtagcagactgaagtggttcttcagaagaatctgtgataactgagcatttgaaaataattctttgacttacagtttctattctacaaagctttctggtatcacaacccatttatttatcagaccatctatgtgaagagggcaataatagatattatttttctctttttttttcagatgaggaaacaaatatcatgggttttataattagtaaatggcagatttgggacttaaaccatgccatttgactgaatgtacagtgcccctttcaccacgctgcttggctaagtgttatgcaatgtcacaatgtcccaggttcaaagcaaaatgatatcgttgtgactgcacactattaaatggtgagagattctcagttgcacccattagaaactgtatgatctcgcttatggtaccatttgaatacagtataaccagatttgctaatgtgtgacaggaaatatttaataaacatatattatatgccagagattgtattagacatcagagacacaaagatgcatgtgcctttatctctactctcaagtagctcagtgttgtggatactggaatcagatagagggaagtgagtgaaaagttgtggaagattttttgccagtggtatgactcaagggttatgggatcatgtgaaagcattcctcttctcaccttaacttaaaaataaattctaatatagatggagtgaataacactgttgtttctcttacgagtattattattacataaataatgtcttttacaccaaatatagcatcttggattattttactaaaattatgatagttgcttcaattggaaatttgttatgctaacctcacaagtaattcagctacatttgtatgaggctcttgcgacttgagaggtaggaataaaattggagtagaaaaaacatctgggagaagctctctttctcggatatgcactttctaattattcctgttaggatctgaacacaggacaccccttgagtcattagtcacatacaccatatatgatttgtgtcacaaactatgctgtaaagtttcagagtacaggtatcaataaatttgttttgttaccctggatgatcgaatattgtgcatgttagtagatgctcaatgaataactgtaaggtaaatgaatgaattgatgaataaatatgaatagagtaaaagaaatggacaaactactccagaaagtgaaagtacattaaatgtttaccacaggtccttcaagagcctaccttcttatatctctccaggatagtccaggggagtaggttagtttttgagattattaaagggagaaaaatatttggatgattatctattgagtagagagaattaatcatcactctttttttctggtgatttgttaagttatttatacaaggctgaataacttttagttatttttgcagaccatcacacatctcaacattcttttcaggttgcaaaggtctagtgtgtgaggcaactgtttaaaagactactcataattaagtgacgatccataagtaaagcacatggagtagtaatatggcatagtggcacttcatattgatactgatgtagtttggatgtgtgtccccggccaaatttcatgttgaaatgtaatctccaaagttaaaggtggggcctggtaggaagtgattggatcatgggggtggatgtcccatgaatggtttagcaccattccttggtgctgtccttgtgatagcaagtgagttcttgggagatctggtcatttaaaagtgtgtggaaccttccccttctctctcctgctcctacattcaccatgtgacatacctgctccccctttgccatccatcatgattgaaagcttcctgagacctccccagaagtagatgccaccacactttctgtataccctatagaaccgtgaaccaatcaaacctttttcgtttataaattacccagtctcagatatttctttataacaatgcaagaatagccaatgcagatatacaaaggatcatatagcaaatgtaggaatgaaagtaaaactgatatttctctcgtagttaatctaaagcccatttcaaattgttaaatgccatctgtccaactgaagaacctaaataaaagcaactgaaaacttgctctgaagtaaacaggtgaatagtatgtaagacaaagcagttccccaaaggcattcttaatacctgctctttatttaacccctgtcttaaaataaacaatgctgatgggatgtgttggagaggtatgatatatgactagtgccaatactgtaggctgataacctatagcatgacatccttatctataaactttgtcagatgcatcactttgttattgtcacttcattaacttgcaccgttaatagcaaaagacagtctttccattgtttaaaacagcaatactttactaagtgaaatatttgagaaacaatgaatgaagttcagtttttaccaaggaacaatcctttacacttggattcatattaagtagctttttctcagtatgagataaagttgtttgcacatcaacagcagacactaaactgttttgccatgaattatttatgctaaataatcatgacagctttctttaaaaaataatgctttgctagaaaatgttactctggatgtctaaattaaacattgttgcctaatatattaatattttggtcttgtgaattttaattggaaacaaacagctgttcctagttggaactaactacgtgattttccaacagtcatctttccactctgggggtacaggggaatttcacaagccttcccaaaaacatgggaaagtaaatcagtctcatcctattatgcatgggaattaaaaaactaatgctctggtgacatcttttcagacaatttaatatttttgcttgctggattttctgccattaccctgatatcagtcacctgatattagattaatttcttatgtcaacttgaaatttgttgtctcaaatcccaactaaaatgtgtttggagctaggatgcaaattacttatttctttgaccttttcctttcccaagagatgtccaaatatgctcaatttcatgttcactgtcctgacctccatagtgtccttgtgttttgtttttccaaatctttaacagttcagcctatctttttgccacatttgctttgtctgtacatctgtgctaatcatatagtatattgtgaaagtagtgcttagtacatgtattagtcagggttctctagagggacagaactaatatgattatatatatatatatatatgtatatatgtaaaggggagtttatttagtattaacttacacgatcacagggtcccacaataggctgtcttcaagctgctgagcaaggagagccagtccaagtcccaaaactgaaggacttggagtccgatgttcgagggcaggaaggatgcagcacagcatggaagaaagatgtaggctgggaggctaggccaatctcttgtttttacattttctgtctgctttatatttgctggcagctgactagattgtgcccaccagattaagggtggatctgccttccccagcccaccgactcaaatgttaatctttttaacattttaacagacacacccagggtcaatactttgtatctttcaatccaatcatcttgacactcagtattaaccatcacaggtccactccttgtcaacttgaacccatacacatcttctgaaattatacataatcttcaaatgaagacaataatgaggtcataattacacctaacatcatatgactatctcttgtacaactgaaaacgcactggtccccaaccctaatactattatataaagttaacaatacttaaatgctgatatgaagtcaataaatcttatgtcacatgataaatgaaaatgaaataaaataaagacattttcttagtacaagcgtatacatgcacaaacatgtttttagcaaaataaggagggaatactcacgaaaattacagtccccgtttctgcagctggtcacgtggtcataggtggtattgatgactaccttcttctactacccatcctatattcccttagccttcagcaagcacctcagcaggttgtgttttttttccctggtaacatgacccaaatcttcattcctgaggtatctgggccatttgtaatcctgcctggattgcactgttgtagttctcattgaccttaatgacagggcatggtaataccaagagacacctaatggatctcctgaattccatgcatactcttccttacctccattgtggagtagtagactgatttcatcctgatagtctgggtcaatcaccctagccaacactgtaactgccttcttagcctgttgacttaaaggtaggaggagcccaaagtgtccaggtggcaatattaacttccagttcaatgggattgttgtgtctcctggtggcagcattcctccagctggaactaagacctctaggccaggagaatgtaatgttgtgggaacggaaagcaaaaattttgctagtggatcactaggggtgatggtgagtgatgccacttctacttccaccccttgattccaggacttatgaatcctggcaatgggaaaaacagtaacatatattggatgctgattcagagcatacatggccttctggagaactttgccccagccctgcaaagcattgtcacctagttggtgttgtaattgtgacttcaaaaggtcattccgccattctatcaatccagctgcttcaggatgatggggaatatggtaagaccagtgaattccatgagcatgagcccactcccacaattctttagccataaagtgagggccttggtcagaggcaatgctgtgtgggataccatgatggtggataaggcattccatgagtccacgtatactagtcttggtagaagatggcagggccttacttcaaaatcctagaggcctttgctgtgattcatttatgggggcctgccaaaggctccagacagcatgcctatctgccattgacacctcaagcaccattggatctgctgggtcatatggcccaagtggcagagtagcttctacagcagcctagacctgttgcagtgccttctcctgttttggtccccactcaaaactggcagcctttcgggtcactcaataagtgggctcgagtaatatacccaaatgagaaatgtgttgtctccaaattttaaataggcccactaggcattgtgccttttcttggttgtaggagaggccaaatgcatcacttacccttcactttagaaggaatatctcgacaggccccataccccagtacccctagaaattttactgaggtagaagttccctaaattttagtcagatttatttcccatcctctggcatgcaaatgtctcaccaataagtccagtgtgtctgctacttcttgctcactggattcagtcagcataatgccatcaatataatggaccagtgtgatattttgcagaaggaaaaagcaatagaagtctttttgaagagttgatataaccctgaggtaggacagtaaaggtatattgctggtctcgccagctgaaggcaaattgcttctggtgggccttatggacaggaatggagaaaaagaatttgccaagtcagtgactgcaaaccaggtgtcaggagatgtgttaacttactcaagcaatgaaaccacatctggtacagcagctacaattggagtcacatcttggttaagcttatgataatccactgtcattctccaatatccatttgtcttctgcacaggccaaatgggaaagttgaatagggatgtagtgggaatcaccacccctgtttctttcaagtccttgatgctgggtctctgcagtccctccttggatgctatattgtttttgatttactatttttctaggtagagcagctctaatggcttccattgggtatttcccaccatcatagacctcaccctaccagtcagggagtcaatgtggggggttccttcagctgcgaagtatgtctatgccaattatgcattctggcactggggaaatgaccacaggatgagtccagggacctactggacccactgtaagttggacctgagctaaaacttcattaattatctgacctccattagcacctactttaactggaggatcacattgatattttgggtcccctggaatcaatgtcagctcaaagccagtgtccaaaatgcctgatcacttcccttttcccaatgcacagttatcctggtaaaaggtcggaggtctccttagagaaggatgtgagaaaggttcactgcaaaaattgtcagtaaggtagtgggattcttcctcaaggggacccagcctccctttcattcaaggggttttgggtctgtaaactggctaactggctcaagtctggaaattgtttgaggggccgtgattctctgtttctataattcaaaccagtcttttgtccattcgacctagaaattttctgtttgtaaaaattaagtaggaatgcagtaggcttcctatcgatttcacttctaggaacacggtgattaattagccagtgccagagctctacacaagtcacactgttctgatttccactttgcctctgctgtccattatggttactatgcctacctttaccttgacatttgagtgtggccagttggtccctgctatcttgggatccaattattcccattgtatttaaattttgtatttgagtgactgaggttcctactgttagatctgacatacagagaagagcaattatagggctcttcaaagattcagctgctgccctcacaaatctatttcacaaggcattggtcaagggtatatctttttgaccctcccagctggaatgagtaggtctaaagtgactaatctactccaccatcccaatcaacctaagcctttggattccttcctctacattaaaccaagcgagatcaggcatttccagctcactcacagtgggacatcttttaatccatatttcagctaaccaagcaaataaactattagaaccttttttttaaactccctcaactgcaacattaaaagcagagtccctacttagtgggcccaaattcataaattctgctcctcttgaaccactcacggtaccaaaatatttattagtcagggttccctagagggacaggacttataggactcaaatgttaatccttctttggcagcagcctcatagactcatccaggatcaatactttgtattcttcaatccaatcaagttgacactcagtattaagcgtcacagtacatgtgaatgttttcatgcagctatatggctttgacaaccatatcaagtgttagactgcaagaagatgatatacttcttcttgtttagatttattaccaatatgtcctgagcacctgtgtcttagtaaatagaccagaattgatgaaaaaactaagacataaagcaatttggactgacagtctagtagctgggatcttttctttctttcttttcaacgtaggactaatttctgtagaaatttttagaagcacttggtcaaagttacgcagttccttcattgtttttgtggtgtgcatcagtcactggagagtatagctctattgaaagcaagccagttacatttgtcttcattttgcctaattccaaatcatcttttaccttggtttttcatttgataagaaaaagaaaagaattgtgatttccttctacatctctattctattcctacatctcagttttcaacaacaggccatcacaatgaattttttattttaattcaggagattatcttgccttggtgtagctttttctttaagtcctcctttattcactatctttcctccccttcattcttggtactgcaattcaatttgctgaatgatatggaaatactttaaagaagattttccccaaaattatacaaaaagtcataaaaatgatttgtactcatcacgacattttatctggagaaaatacatggctctcactgtactttagctgtagtgcagcatttccagtaagagggaaattacaatattttctttgaccagaaaataattgttagttagatgtctgggagagtcatgttttgagaaattaataaaatgttgtgtatatataagaaaatagtactgcctctataatccactaggtttctgagaggaaggaagaaaaggtactcattggttttattatctttttgttctcaagacatcaaagctccttctgataagatttctggtttgaagtcaagcaacatattgctaatttatattgagaaagaggtaggggaccaaaatgagaattataactgggaattggagaaaaatcaagaaaatgtggaaaactgaaaaatatatgtttagggattttacacaattgtatatgcagaaaactcttcttttgtatctgaaattaaagccatagagtgatgaacagaaatgtgactgtgtatttgtttgaagaaatgagtggtcagtgtaaattccagagagcttgactgggttgggtgggaagaatacaacttatacaatggactctcacagtgaatggattcaagtcacttatcctctagttctactatcttaagtgggatttattgcatagatgtctatattctatgtgtttctcattgcagttgatatacagtattttaaaaaatattcaaggtgtatgtgtgtgtgggcacacacatttattataaatgatcttgctgttacttaacagacacttgagtgcctttaaactgcatttctgtttatgagagtagcaaaagatgcagaaatgtctgttcatcagcaagatgagagtgaagagtgtcttagtccattttgcattgctagaaaggaatacttgagaaaagggatttatttggctcacagttctgcaagctgtataagaagtgtggtgccagcatcggcttctgttgagggcttcaggaagctttcattcgtggcagaaggcaaaggggagcagacatcacatggcaagagagggagcaagagagagaggggagggaattgccagggacgttttaacagtcaatcaggtcttggcctggtgtggtggctcacgtctgtaatcccagaactttgaaagcccaaggtgggtggatcacctgaggtcaggatttcgagcctggccaatatggcgaaaccccgtcactactaaaaatgcaaaaattagccaagtgtggtcgtggacacctgtagtcccagctactcaggagtctgaagcaggagaatcccttgaacctgggaggtggaggttgcagtgagtcgagatcatgccactgcactccagcctgttcaacagagactccatctcaaaaaaaaaaaaaaaaaaaaaaaaaagaaaccacagtcagatctcccatacactaatagatcaagaagacactccattactgtgaggaaagtatcaagcctttcatgaggaatctgaccccatgacccaaacatctcccatctggctcaacttccaatattggggatcaaatttcaatgtgagatttggagaagacaaatatccaaactatattgaagagctctagatttactaaattgttttaaagtatattagtcaattttcatgctgccaataaagacatacctgagatgggtcaatttacaaaagaaagagatttattagacttacagggccacagggctgaggagacctcacaataatggcagaagacaaggaggagcaagtcacatcctacatggatggcagcaggcaagagagagaacttgtgccgggaaactcctgtttctgtttttaaaaccatcagatctcatgagactcattcactataatgagaacagtgcaggaaagacccacccccataattcagtcatgtcccaccagattcctcccatatcatgtgggaatggtgggagttacaattcaaggtgagatttgggtggggacacatccaaaccatataattccacacctggtccctcccaaatatcatgtcctcacatttcaataccaatcatgtcttcccaacagtcacccaaagtcttaactcatttcagaattaaatgagttaattctcatttaaatgtccatagttcaatgtctcatctgagacaaggcaagtaccttctgcttatgagcccataaaaatcaaaagcaagttagttacttcctagatacaatgggggtaaaggcatgggtaaatacagccattccaaatgggagaaattggccaaaacaaagggactctaggctccatgcaagtccaacatctagcagggcagtcaaatcttaaaactccaaaattatctcatttgactccatgtctcacatccaggtcacactgatgcaaaaggtgggtgcccatggtcttggacagctccacccctgtggctttgcagggtacagccttctcccagctgctttcacaggctagcattgagtgtctggggattttccaggcgcacaatgtaagctgtcagtggatctaccattctggggtctggaggagagtggccctcttctcacagctccactaggtggtgccccagcagggactctgtgtgaggtctctgaccccacagttccctttttcactgccctagcagaagttctccatgagaaccctttccctgcagcaaacttctgcctggaaatccaggtgtttccatacatcctctgaaatctaggcggaggttttcaaaccttaatttttgacttctgtgcacttgcaggctcaacatgacatggaagctgccaaggcttgaggcttgcaccctctgaagccatggtcccagctctatgttggcccatttcagccatactcagggcagctgagatgcaggacaccaagtctgtaggctgcacacagcacgtggaccctgggcctggcccacaaaaccacttattttccaaggcctcttggtctgcgatgggaggtgctgctgtgaaaacctctgacatgccctggagacattttccccactgtctcggggattaacatttggctcctcattacttgtgcttgaatttctccttaaaaattagggttttcttttctatcacattgacagactgcatgttctccaaacttctgtgctctgcttcccttataaaactgaatgtcattaacagcgcccaagtcaccccttgaatgctttgctgcttagagatttcttctgccagataccctcaagttcaaagttccacaagtctctagggcagggcccaaatgcctccagtctctttgctaaaacataacaagggttgcctttgctccagttcccagcaatttttttatcttcatctgagtccacctcagcctggatttccttgttcatatcattatcagcattttggtcaaagccattcaggaagtctctaggaagttccaaactttcccacattttcttgtcttcttctgagccctccaaactgtccccacctctgcctattacccagttccaaagtcttttccacatttttgggcattttttcagcaacgcccaactctactggtacgaatttactgtattagtccattttcatgctgccgttaaagacatacccgagactgggatatttgcaaaagaaagaggtttattggacttacagttccacatgcctgggagacctcacaatcatggcagaaggcaaggcacaacaagtcacatcttacatgtgtggccacaggcaaaaagcaagagagcttgctcagggaaactctccatttttaaaaccatcagatctcgtgagactcattcactatcataagaacagtgcagtaaagacccaccctcataattcagtcacctccctctggattccttccatgacatgtgggaattgtgggagttacaattcaagatgagatttgggtgtggacacagccaaaccatatcaaaaggctactttctcatggttagcttttgtgatgtagaatgtgaatttcatgagaatgttgctgttgtgaggggattatctcagaaaattatgtggaatgataacaccacaaagtagtcacttttgtaggtaatgtcctgatccttgaattgaggtgaggatgccataagaccatacagatgatgcctagcttcaggaggtagcatggtccaatagaaagggtggaattgttggcatcggagatatcttggttcaaattcatgcactatttcttctagctattgtgacctggggaaagtttctcaaactctgtgagctcagtatgctcagataaaaaaattaaactagtatgcacgttgaagcgttattgtgaagattagatgagaactgacacaaaccactacttaataaatagcattctcacctgcagtgaacatccctactcatacagtttttctgttggcttcggatcctcatagagaacaaaaacagttaaggaataaagcaaagtggctagtcaatcatatatacctcaattatgggaaggcatgctggtgaaggtacagtgccagtgccataatgccagataaataagtaactgcactttgtatgttctatattttattatgctctaggttcctgaaaaagatatttttcttttggccagaaataatcactgatgactttattgtcttgtgatgcataaatgaggaggcagactgttaataaatttttgtgacagacatgaacatgcacactttcttttccttacataattatgaatttgcatctttagagagggctttgttaaaatattccatggagtttatgccttgtctaataatatcataggtactgtgcatgtacttgtggccaaacagttttctttttgtaacagaacacatttatatgaataaaaaaccgaacctgtcatattttcccagcggcttacttttacggtataattacattacagaaaattgaccctctgtgtaacccttaattatattcacatgcatctaaagtatattgcttaatgtcagaagttaataataataatatacttcatttacttttatgtaacatttaaagaacacaagaaattgtaaacgtttaaagttatttgcttcactgagacatgaattaataaaggttttgagcctatgaattttgtctcttagatgtcaatgattttggtcattttttactttatcacttttagaacattttgaacatttttaaagaagcttggtagattgtacccttaaatggtttttaaatgactttcaacataataaatcaagcccaaagaaaaatataaatatatattatgaaagagttttcaggaactgatggtagaaggctaattttcatccacttattcaagcagaaaatatgtttctcttcaagacttttctccccatttgtcatgcacaaaagcacacaatacttttaatatacacgtgtacacggattttcagaataagtaaattataaattataaatgtaagctttatggcacctctttatagaacttgaaaattaagaaaatatttcatggcagatgctttcatttatgcatccagcaagtatttttgagtgctcacatcaatagttaacaaccatatagtgcttcataatttaatgagtggtttaactcatgttatctcatttgatttttaaagcagccctaggagtttggtggtgttaagtaaagaggtaggtcttttaagagtgacagatcagtgatgccagtattatcaatgactggcagaagatttaaggcaactcatttgagtggtaccttgaagggtgattgatttgactaagtgtagaatgggaatggcaaaaacaagagcaaacacggtttttggaagagaacttggtagaaaaattttctttgcctttttcatctccttaaagataaatccaaatccccaacaaatgaagttattattttaaagtgaggtttagctagtgggaatttttccatagaatattgatttatataactaatttctacattaattttaaaaaccttttgtagtatgaatatattggtattggtttcctttgttaaatctacttctattataaaaatgattatattgttggaatgctacttatctgttagctggagggagaaacttcttaggtatatggaagaattatgcatattttgttttttccaaccatttgtattggcaacaagacctgcttagtcatacaggataacatttataatagttaaattcttaccattgaccttgcagctatgtaaatagcttcacagtttaatgtaatacaccaagtgagagaagccatctgaggagagttgaggcaatgggccagaatacagctgaaaaatttaaacttatgccaataacttgtatgtaggaactactcagtgaaaattgagggaaaaaaatctcaatgtgtaaatatagttcattgtttcttggtatttaaagatgtgacatccttacaactaagagccattttttttaagttagcgcagaacagaagggagctgacatatatagtgtgcatgatgaaatgagttgaataaatattctacagggaaaaaaaggtgcagatccaagtttctatttgatcttttttttctgaatcaactgacaggatagtttcaaaagactattttgtccttggtttgttttatattctaattccattatttacttactttgtctatagttttccttccttttctagaggaagttgacagttgataatagcattgccaattttggaaccttttgtgatacttgtgaggaaagtttaccctataattggctgtctctcatacatgaaaatcacacttttgagtcttagtatgaatggtttttcaagtgtttttaaaaaatttttttgtgggttgatgatagtaggtgtatatatttattgggaacatggaatgttttgatacaggcatgcgatgtgaaataagcacatcatggataatgggttatctattctctcaagcatttaccatttgagttacaatccaattacactctttgagttattttaaaatgtacaataagttatgattgactctagtctccctgttgtgctatcaaatactaggtcttattcatttattctattttttgcatccattaaccatccccacctcccccaaagtccaccactatcttttccagcctctggtaatcatccttctactctccatctccatgagttcaattgttttgattttaagaccctacaaataagtgagaacaggtgatgtttgtctttctgtgcctgacttatttcatttagcataatattctccagttccatccatgttgttgcaaatgactggatctcattctttttatggctgaaaagtactgcattgtgcatatgtaccacattttctatatccattcatctatttttggatgcttagattgtatccaaatcttagctactgtaaacagtgctgcaacaaacacaggagtgcaaatatctcttcaatatactgatttcatttcttttgggtatatagccagcagggagattgcggaataatatggtagctcaatctgtagttttgaggaacctccaaactgttctccacagtggttgtactaatttacactcccactaatagtctaggaggctttcctttactccacatcctgaccaccattttttattgcctgtcttttggatataagccattttaactggggtgagacaatatctcattgtagtttttgatttgcatttctctgatgatcagtgatgtttttcaccttttcatatgcctgtttgccctttttatgtcttcttttgagaagtgtcttttcgaacctttggccctttttaaatcagataattagatttttttttttctatagacttgtttgagctccttatatattctacccttttcagatgggtagtttgcagatattttctcccattctgtgagttgtgtcttcattgattgtttcctttactatgcagaagctttttaacttgatgtgatttcatgtgtctatttttcctctggttgcttgcacttgtgaggttttgctcaagaaagttttgcccaaaccaaagtcctggagacttttcccaatgttttcttgtagtagtttcatagcttcaggtcttagatttaggtcttcaatccattttgatttgatttttgtatcaaatcaaagatcagagataggggtcaaatcagaaatagggtctaggttcattcttctgcatatgaatgtccagttttcctagcactatttattgaagaaaccatctttaccccagtgtatactgttggcatctttgtcaaaaatgagttcactgtaggtgtgtggatttgtttctgggttctcagttctgttccattactatatatgtcagtttttatgccagtaccatcttgttttggttcctatagctctgtagtatagtttgcagtcaggtaatgtgattcctccagtttttttttctttttgcttaggaaaactttggctattctggatcttttgtcattctacatacgttttaggatgtttttctatttctgtgaagaatgtcattggtattttgatagggatttcagtgaacctgtagattgctttgtgtactatggacattttaacaatattgattcttccaatccatgaaaatgaaatatttttttctattttttgatgtccttctcaatttttttaatcagtgttttgcagtttacattatggagatcatttacttcttcagttaatttctagctatttaaatttatgtgtgggtattgtaaatgagattacttttttatttttttcacattgttcactgttggcatataaaaatgctactgagttttgaatgttgaggctgtatcctgccaacttactgaattttttaaatcagttcaaatagttttcttttgtagtctttaggtttttccaaatataatatcacatcatttgcaaacaagaatactttaacttcttccttttcaattttgatgccctttatatctttctcttgtatgattgctctagccaggacttccagtactatgttgaataacagtgatgacagtgaacatccttgttttgttccagagcttcgagaaaaggctttcggtttttccccagttagtatgacacttgctgtaggtctgcttatatggctttcattacgaggcatgttacttctaaaacaagtttttcagggtttttatcaggaaagaatgtcgaattttattaaatgctttttcaggatctgtggaaatgatcatatggttttatttttcattctgttgataccatgtatcacattaattgatttgcatatgttgaattgtccttgtaccccagggatagagcccacttggtcatgatgaataatctttctaatgtattgcttaatttgatttgctagcattttgtttaggatttttgcatcacgattcaccagagatgttggcctatatttctctttttttgtgtgtgtgtctttatctggttttagtatcagggtgatactagtctcatagaatgagtttggaagtattccttcttctcctgtttttttggaaaagtttgaatggtatcggtattagttcttctataaatgtttggtagaattcagcagtgaagccatcaggtccctgcattttctttactagaagactttttattatgacttcagtctcattacttattattggtctgttcaggttttggatttcttcctggctcgatcttggtaggttgcatgtgtctagggaatttgtctatttcttctagattttctaatttattgacatataattgctcataacagccactaatgatcctttgagtttctgtggtatcatttgttatgtctcctttttgatttctgattttatttatttggatcttctctctttttttaaattagtctggataaagctttgccaattttgtttaacttcaaaaaaccaactttttgtttcatggattttttgtactgttttcttcatttcaatttcacttatttctgctctaacctttattatatttaagggtgtagggcaaaaggatcagctttacttactctgagttatagtgaagacctatgaagcacagattattaagtgaaatgatgaactagggttaggtgagatttgaggtacagtattactcagatgggctaggaggacagctccccgggcaacatcaaataactatgtttagtagtgataagtagtagaagaacaagtgtgcctcgtagtagaaaaataagttggaaattatgagacctgcaatgagcaggtagtagactcctttaggatgaaaaattaacttgaaagaaggaaatgtttgcattactgaaaccgcatgcttagaagactcatatattggaacaattatgtaaagattcttcagtttttaaatgataaatattgtagccacaaaattgaatggtgagcatggagctgctctttcctcttccctatatggactttgtgtacacataaagttagctaggcaaaagaatgtttatcatagtattaaagttgtcactgctgcaatttccttctgttgatggggtaacattatgtgtgtgtgctacatacgtgcacacctatcaaatcttttccccactccatgtgtgtcctctctcttctttggtagctatagctgtttccttcacctctgatttgcttcctttctctacttaagaacatactatttctgagacttgatttggctgtgtcatctatgatgttactctaaaaacatctttttaatcatcaaaaaatttctttaaagctacaattaccaaagaaagttattgtagaagattcattaggtaactttctaatgtaatatattcttaaccctaaacaattttgctaaacttatacagcgatatactttttcccatttctaggtgcttatgtgcagagtaaaaataaattgtacctttatttcctggtctgcctccagcttttctttgcagagagaggataatttcccatcatcatagtttcaatatttcaatttatcatgcttactagaattgtactctaagtcctacactcattcctcagtctaaccccaaagaggcaagttatagaatctcccaagatagtctgcattttgagtatttccatttgcctttattcaccaagtggaatttaaaaatgaacaataaccagaaatatgttaataaggaactagtaaaaacatttcataaggacacattaaatccaattaaaaccctctagaaaagctggtgtatttgcttttttaatatatttcatttagaaagtgcctatcaggcaaaatgcagaaacaccattaaagtatttagaatacatccttttttgtcagttttctttttgttatttctcttgcctaatgactccacttatatcattcaaaaggagtcagtccggatgataggagctctttgttacatgtaatagcttacaagagcaatttactcctacctgagccagactgccctttatctataaagacaggctgtgctgtagattgaagtctaggattggtggtacgttggacatggatcatacctcttaattgggtcacaaagcattgttgtatgtttgagagatggggtttttagattttttccagaagtaatgctggaaattgtggaaaattttttataaattaagaatttgaggatctgatgaatagaaaattgttgaggattagttcccccactcgagggaaagatttttaccactttttcttatcagtgatttatttctatgaaataaatttgttctgagcgtgtagtgaattgtctgtggaaaaaagaagtccattctgggactataaatgttagaaatgaaagttgttccgcaatctcggaagtatttccgctggtttagagactatggctccttattacttggaaatgctctaaactttaggtattctttgctgaaactagagctgattctacatccctaagaacaatttgtttagaaaaagaattcttttaaccaaagttttcatgaaataatggtaaattaaatataaatgaaaagccttaaatatataatctgtaaaaagcagctaccattatttgtcaactttgttcaaaaaatggaaataaaacaactaaagtcaaagaaatatgaatcaaatgacctagctgacagtaaaaggaaatgtttatgtttacattttgactttagtctcttagctctactctcagaaaggttgatggctgaaggattattttagaaagcaaaagattgaggtagtgtaagtagttctttaatttcagaaattgaccttgaacacttttttggttgagtaatgaaaaagcgtggattgttattcaaatttcagctcacttaaatggaagtgtgtggaatacttaaaagttagactacctgtcctatttaaaaattctaatggaatttatactaactaaagtagattgctgaatttagaggatgcacaaaattaggaaaataggttaaatagatcagttaaatcttatattacaaaatttacaaattaataaggtagtaacttaaatataatgtgaacatgctgtatgatataccaaataatgataaaaaagttaagattaaatagtagcctttgaaattaatattgtacatattcattcaaaaatgtcagtaaaaattcaattaaagggatgagcataaatacagattattaaatttataataatttatactgacatatattcccataagttactgaatacaggtgttaaagtgctgctttggtttttatttttacaaaagccaccatgctaatgcctctttgattgtcatctgcttcagacggatgactaattactattatgatgttttgggtttaagggctgatctaattctacaaatagaattcctgcagacaactgaaaatgtctattattagaactgaaaaacattcaaatgagtggccttagaggtgaaaggctatcttaccattttcctctttagttacttagaaatttttttaaatatcttagcatattagttgatatgaaattttaacgccagacaagactataccatatgttatttaaattcccattcctaagtttcgattcactaggttttttgaaaaaaaaaaaaatttcaaactctttaatggcctggatttgtctgaaactttacttagtattatgggagctcatccttaagcttgttatttttcatagggtattttataatttgaagataatactaagcagtaaagttcagtaacaaaggacttaactgcaataaaattgtatatacacgatttaattctctctttttaggcaaatgaagggtaaattggagacttaaaagcccagcatgtagctataggctccattaattcacgaccagatctaccctgctcttcattgtatcagcatctaaaatggtgcatggcctggcatatactgtacaggttgttgagtgtataaagggcagcttaggtattctctgaatttgtcctttataaaattatagagcctgtgggcttcggaaaatgcagaggagacatttatattcttttctgagaaaaaaaaaaattggaatcttaacaaagttatatagagtgaagaatccctttctgtgaattcactttcactgggtcctattatttttttcttctcccagttgcattttaccccatactttttataaattgtgtttatcaagattgaaatgaacatatctgattttgatatgggaaaagaaaagcacttggggcattgaaataaacactgattccaaatgtaacccgcaggtgtttgggaggatgaagaagttgtcaccgttaatactataattcaaataaaacatattgttgttaataaaatgacttttctagagtgcatttcttttcttttcttttcttttcttttcttttcttttttttcttgagaccgtctgggtctgtcacccaggctggagtgcagtggtgcgatctcggctcactgcaacctccgcctcccaggttcaagtcattctgttgccttagcctcccgagtagctgggattacgggtgtgtgcaccaggacacccagctagtttttgtatttttagtagagatgaggttttgccatgttggccaggctgttcttgaagtcctggcctcaagcaatctgcctgcctcagcctcccaaagtgccaggagtacaggcatgagccaccgcgcctggcctaaagtgcattaaatgattccatttcttttctgaaacatagaacttttagaattttatagagataaatcatacaaagtgaaataacttctggagtggaaaatgtgaattttctgtttcagcactggaacaaaatgtggaatattttcacacagacttttatggaatccatctgatttcagtgaagtccagtgacaaattctgtgcaattgatataatattgtggcatggtttgaacaagtttaggcaaacttatctggcattcttaaacttctttttatagtttctattattttgtactttgtaatatactttatagcttgtattacagtcttgtattgtgaagctttaaacctgaggtatttaacatgataggcactaggtgcatgtagctattgagattttgaaatatggctagacaaaattgagatgtgctgtgagtgtaaaatacacactaagtttcaaagatagtatggaaaatgttaaataactcattaataatttttaatgttgattatatgttgaaattataatattttggatgtatggggttaaactattaaaattaacttagctgattaattatacttttaagaatgttagctactagaaaatttaaaattagatgtgttaccgacatggtatgtctttctacgtgacaatgcgtttccaaattgttttaactgaattatatctaaatctggcaattctcctgtgggtacaacgtaggcactggctttatagaagaaactgaccatgaaggtcttagccataaggccatttcctacagccagttgaaaatgcctattatcgtactggtcatttttggttgagtgattatcttttcttaattcaccttctctaacaatgaagcatggaaggataattaaggatcccaaaaagcattcttctctccttgctacacaaaagatgcagtgtgctcacgtaactcaaacctatccccctgttttaaacaatagtaataagaggcatgcagagtcattttgtaagatgctgaagtattataaaattggtgagacgatgacatgttttttgttacctaaaaaccttagcttgtagtcctattcaaagttgtaaccactgtgcatgtccccttctaagcattaattctgttgtgagtgactaaatgctatagtttgctgacttgaagttttgtattttatttattgattttattaagtaaatttcatctctttaggcttgagagtgaataatctaggcatggtaatcatgtgtagtgatttttttatgggtttatagtttctccaaagagagaccaggagctgcaaaaagcaaatttgcatctctctcttgatggtttatatgacttaaaagtgcatagccagccttacataaattttgtgagcctgggaaaattgggattattattatttagtcgaattggttttattgaattatttaaggttgaagtaataggtggtgtaatgcttgagataattttttaaagagggaaaaaagcaaaatgaaacaaatggtatcttacttagaaggctgtgtccaaatggacttaattaccacaaaatttgtcataatatgtagtcagcagttatagagaagaataatgtgagcttttgaggacttatatctgatggagagcatgaaagatcagacataggatgtgaatgtgttgattggcataagaagtgtagtgctagaaatagaattctttaaatgcatgtgtccgaatggcatacatagaatgactcagctcttccatatcatatgttacatcaccacagcattgtaacaataataataaagcaatataataacagtgtaattagaataataacagtggccatttgtacagtctcttaaaatttaaggttctgaataattagattacttgcttaatactagttgtctaatttgtaccacaagtagacagtggctattttgaatttttactagtcatccatttgatgttatattcttctttaaacaaatcataaggttgaatttgtaaaggtagcactaattattatatttatggtatatattctaggataatattggggcaagataattagaattaatgaagagctttccatattgttagagtttttacagtctcagtaaaaaaatgtatttgttgtttctggattgacaactttataataaagaggaagtttaaggtccagagaaaactcattttaataaaaaagaaatctatttgctggttttatttggattgacaagcatgctcagcatgctggctgccactgaaacacgcttcaacagataaatctacaaagtccccaaagtcagcttaaatgttgaataacttagaatatcagaatcttggaatggtttgagcaacagaaaagaagctgatttttgtttgttttctctttgatttgtttgtaggtacaaaacagaatccagtgattatttgcattttcccatgatattgttaattgctactgttttaaacaaattgtagagtagaatttcaaacaaatatcaccaaatgagctcagggttctgttttccctggtactgagtgacagtaatcctgacaaaagagagttactgccattagtaaatgctgttatgtagttccctccatagtctgtaatgcacgttgataacaataggaaggaccagaaatgcgaagaaatatcttgaaggttggaagaacactgaggtgtttcaaatgtcctaggcagatatattgattaacagaaattttggttgttgggccagacttacatgtgacactatgcattggagactcaaatgatgcatctcctttatagacaggaatttggtataaggcaggtttggcttgactccagcctgtggatttattactgtatctatctaaagaacttcatctatgaaattccatgtttgtggagttttaggtttagatttacagaattttacacttgcataggcagatgagttgtatattagttaaaagctgtgcttgtggatgtgaatcacattgtgaaaatgaatctattaagactacaggacacaattcggccactggagaattggagacaatcagtaaaatcatatgtagaagaagcattgcgtggtcgttaaatacatggactatggacccagactcttcagtttataaccctagattcatcacttgctagctatgtggtcttggacaatttgattaaactgtgtttcagtttcctaatctgtaaaatggggatggtgataacaatagtatctacctctagtgttattttaataattaaagagtttagtttttaaaagtttttggaacaatctctgacatgtagaatgagcatgtgtaaaatgctacaaagatgatacaaaaagtgtctgttaagtataaaaataaaattgggagaagaaataacgtcaaccctcatcaatgaaattataggctattatttcctgtagtaagatctagacaaatcttgcctgattagttccacatggttaaatatgtaaagctaacacatattattgtggtttctttgataaatttaatgggtgcttcagatttatccagggtaagtcttaggatatgtccaaacaaaataatgtccagttgtaaaaaaaagaaaggtaatcctcaataatttaggggatgtttgtaacatttcttttcttccttctttttttcattcttctgtatacaaggcagtatgctaggtagctagaactttaattagagcatagttaggaaaagaaaaggaaatggagctttgttttttaaattattggtggcttttacagatagtttgacaggaggaaccatccaggctgtaattgtggtaaggaatacctggttgaatttcactttttatgtctttattttggaattctgtagctaggtagttacactgttatgtaaaattaggctaggaaattaagcttctacttaatttcttcatgttggcagattatcaggtgtgtattgtagtaagaaagaaggcccaagcattgaagaaaaattagcaggagtttattatatttaacagagaaggcccaagcaatgccaaacattatcatgcatgtccctgggccaaatctttgtgagaactgttgtgtgaatggtatgcagtgttcacagaaggtaatctacagcatcaagtaatatgacagacatgaaggcattaattatttgtgactgtactaggcagtttgctattccttaatgtctttgatgttttgatcaataactgtatgagagaaaaaaacatactttttaacaaggaggatttcattcattagatgttaacgctttaaaaaatatatgaaagacacagcgatttttattttatgccgacttttatttttttatttttattttttgttggtacataattatatctgtttatggagtacatgagatattttgatatgggcatgtagtgcataataatcacataatggagaatgggatatccatcccctcaatcctttgtgttgcaaacaatctaattatacttatcgctacattttaaagtgtacctttttaaaatgtaagctaatttcttcacttatgacatgttgattgattgctatatattttctcaatctatctcagaataaaatatttcacttctcttgatggctcatttctcttatcatggtatattcacttattttttaatacaagtaaaagtatagaaacatttcattatttaaactcattttgcaatttgacaagattaaggtacagttgtaaaactcctcaactaccttcattatgtattaccaggtcccattttgtccctttttgtgtacatccatagaagattcttttttccaccactgtttttgtttttcttgaattctcttcaaacagactgtattagtccattcttgcattgctataaagaaataccagagactgggtaatttttagagaaaataagtttcattggctcacggttgtgcaggctgtacaggaatcatggtgctgacatctgctcagcttttgggaaggcctcaggaagcttataatcatggcggaaggtaaagagagagcaggcacatcgcatagcaaaagcaggagaacgtgagagagattggggttgggagggggaagtgccacatgcttttagatgacctgatcttgtaagaactcactcatcatgagggatgttcttacaagccatgagggatctcaccaagccatgagggatctactcccatgaccctaacactgcccactaggccccatctccagcattggggattacaattcaacatgagatttgggcagatattcaaacaacgtcacagaattcggtaagaaaatttgatttttcagtgagggctagacaaaaggagtgccaagtgggtaaatgagttgtgactcatctgatgatttttatttatcttggaaaaacacctaacttcttgattctagcttctgttgtggcaattactttccgtatttgtcaagaacttttaacatcaaggttttcaagtttggttaaatataaaattctttcagtaatgatcagccgcttatattgaaaacctgtgcatttccaaatttatatacatttgaatttaatagttctgtttgttcattagcagaaacttaaatcacataataaaatattaaaacaaaattgaatcaaagcaaatgtgacttaaaaatattatgatccattcagtattattgggttttcaaaatcatacaaagtttgatttcaaaaaaatttcccaactgcctgtttttgctttggaatgtccacatcgatacaattttggaaaaatttttgagtgaagatacagttgcaaatttaggtaaaggttgaatttctattctttccaaagcctaccatcttgtagcattgtacgtaaatgaccctgcatttagtagagtattaatttgtatattttactcatagaaagctggatacaaatgtcagggtgagaatgtgcattcatttgtaaggcaatccgtctcccctttttacaaataaatggcagttagcatgtacaaaatagcattaagtagctaatgcctatgatttaacaagggattagtgatccaaataagtgaaatctgtttctcctaaacttgtggcatttgtgaatatctttatttcataataatttgtagaagaactgactgatttctaactgaatttgatggactagtaaatatatcccacaatattttagtacaaatatcttctgtaatttctgagggagatctataattcattaattaacacgttattagtttataatgtattatgaaatatgagcagttcctttaattatagacctccccaggactataccataaatcctgaaatctctattaaaaaatttgaagttatgcttataaggaaaccttgatcaactgccatattaattcaagggcataactgaaactcttcagtagtgttccacatttgttttcatcttgttcaagattaaactcctgtggcaaaagtggaactgaaaccaggcacatttttttctacctaaggtggtgatatatgtatatatatatatatatagagagagagagagtaatacatcaaacacagatatgaatagaacaaacatagttttgttctttagcctgttgaggtgatggactgtgttaactggttttcacaagttgaatgagatttgaataaatggaataaattccacttggttatgttgtgtgattattttatacattgtttcatttactttgatgatattttattgacagatttggactgtggtttttttcttgcaatgtctttagttttggtatcaggttaatgctaatctcatggtttgacttaggaaatattttctttgattctacctttaagaaaagattatagagaattggaacaatttctttcttaaattcttggtagaattaatcagtgtacaagtctgggcctcatgctttttattttggaaggttattgtttattgattcaactttaaaaatagatataggccttttcaaagtgtctacttcttctatgaaatttggtagatgtgtctttcaaggagctggtccatttcatgtaagttatcaaattgtgagcatagagttgttaataatattcatatatattcatatactatccttatattgtccatgagatctgtaatgctgtcccctcttttatttctgacattagtgattggagtcttctctcttttattcttaggtatcctggctagaggcttattgattgtattactctattccagaaacagcttttctattccttgtttttctcttttgacttgtttttaactttgttgatttccacactgatttttttattgatacaacatattttacatatttatggggtacatattatattttgttacatgcatagaaggtgtaatgatcaagttgggatatttagggtatccccacatcggtatttattatttctatgtgttggggacatttcaagatctctctttcagctacttagaaatatacaatacattgttgctaactatggtcatcctactttttattaaaatgtatacattctatctaactgtgtgtttgttcccattgaccaacttctatccattcctcctacccacccactgaaccttcctagcctctggtatttaccattctattctctactttcataagatctactttttaaattcccacactatgaggaaaaatatgagatttttttgtgtgtgtctggcttattttacttaacataatgacctccagttctttctctgttgctactaatggcatgatttcatttttaatgctgataatattccattgtgtatatataccatactttctttatccatgcattcattgatagacaggtcaattccatatctttattattttgaatagtgctgcaattaacctgtgagtgcagatattgctttgctacaccggtttcttttcttttggataaataaccagttgtgggattactggtagtttttttagtttttttttttcttgaagatttgatatattcaattttatttttattttatttgtgttttttaaacttttattttagattcaagggtaaatgtggagatttattatatatgtaaactcatgtcctgggggtttgttgtacggattattttgtcacccaggtactaagcctagtacccaatagtttttttctgagtatctcctcctcctcctaccctgtaccctccaacaggctccagggtgtgttgttcccctctttgtgtccatatgttcttatcatttagctcccacttacaagtgagaacatctggtatttggttttctgttccttcattagtttgcttaggataatggcctccagctccatccatgtttctgcaaaggacatgatctcgtaggtttttttttttttttttttttgagacagagtttcactcttgttgcctgggctggagtgcaatggcgtgatcttggctcacttcaacctccgcctccagggttcaagtgattctgttgcctctgcctcccaaggagctgggattacaggcccctgccatcacgcccggctaatttttttgtatttttagtagagacggggttttgccatgttggccaggctggtcttgaactcctgccctcaggtgatccacctgcctcgacctcccaaagttctggaattacaggcatgagacacggcacttggcccgaactcattctttttatgggtgcatagtattctatggtgtatgggtgccacattttctttaaccagtctatcagtgatgggcatttaggttgattccatgtatttgctattgtgaatagtgttgcaatgaacatagacatgcatgtgtctttatgatacaactatttatattcctttgggtatatacccagtaatgggattgctggatcaaattgtatttctgtgtctaggtttttgaggaattgccacactgtcttccacaatggttgaaccaatttacaactcccaccaatagtgtataagcattctcttttctctgcaaccttgcaagcaccagttattttttgactttttagtaatagccagtctgactgtgtgagatggtgtctcattgtggttttgatttgcatcttttatttttagtttgttttagaagtctccataatgttttccatagtggctgtacaaatttacattcctaccaacggtgaataagaatatagttctcttcacatccttgccagcacctgttattttttgactttttaataatggctattctaaccagggtaggatgatatctcattgtggttttgaattacattttcctgatgattaatgatgttggacattttttcatataactgttagccatttgtatgtcttcttttgggaaatgtctattcatgttctttgcccactttttaatgaaatcattattattacttttttactatcgagttgtttgagttccttgtgtattctggatttcagtcccttgttggatgaatagtttgcaaatattttctcccattcaagagggtatttctccattgtgttggttatttcctttgctgtgaataagttttttagtttaagatagtcccatttgtctatttttgtttttattgtctgtgcttttgatgttttagccataaaatatttgcctacatcagaattctgaagtgttttctccatgttttctagtaactttatagcttttggtctcacgtttgaatctttaatctatcttgagttgatttttgtataccatgtgagataagggctcagtttcgttcttctgcatatagatatccaatattccactctaatttttcttctttcttctgctcagtttggatttaatttgcttttttctttttttagtttcttaaggtagaagattagattattaattttatatttttcttcatttctaatttgtgccttcaatgctgtaaatttccttctaagcagttttttctgcatcccataaattttgaatagttgtatttttatttttatttagtacaaaatatttttaaatttccatggaaacttcttctttgacccttgtgttatttagaagtgtgtttaatctccaagtattctgggggtttctagctatctttatgttaccgatttctgtttaattccattgtggtctgagaacagaccttgtataatttcctttcatttaaaattgttcagggttttttctatggcccaaaatgtgatctatcttagtgaatgttccaagtgaacttgagaagaatgtgtaatttgctgttgctggatgaagtaatctacagaggtagattatatccagttgattgatggtttcactgaattcaactatgtccttactgacttcctgcctgctagatctgtccatatctgatagacgggtgttagagtctcctgctctaatagttgattcgcctatgtattcttgaacttctatcagttttgcctcacattttgatgctctgtggcatatactttaaggttgtctgtgtctttttggaaaaattgactcctctctcattttgtaatggccccctttatttctgataaatttccttacactgaagtctccctggaataaaattaatatggcaactcaagctttcttttgatttgtgttagcatggtacaacttatccatccctttacttttttaatttgcatacatatttatatttaaaatggaattttttggcaaggtatagttggaccttgtattttgatccactctgacaatttctcttctttaattgatgtatctagaccattgaagttggatacacatctaacatatttgttactatttttaattcattgtccttgttctttgttcttatttttgccttccatcctttttctgctttgtgtgtgtttgtatgtgtttcttttattttggtgcagacattcttttttaaagttttgtgtaaaaatcaatgcaggatatttagcatatatattgcctcatgtatttatcatttctttgttgtgagaacattaaaaatcttgtcttccagctattttgaaatttataatacaatattgttaattgtagtctccttatgtagttactctactgtgcaatggaacagcagagattatccctcttatgtaactgtaatgttgtacctgttgaccaacctctccctctctcctccctcgcaccatttcctagatgatggaaaccactattctactctcttcttctataaaaccaacctctttaatttttaatgtttatgagtaaatggtaggtgtatatatttatagggtgcatgagatattttgatacaggcatatagtgtatagtaatcacatcagggtaaaatggggaagccttcacctcaataatttaataatttatcaatattagatcttattcattctatctaactatattgttatgttcattaaacatctccacttttctccctcctccccagtgcccttcccagcttctggtaaccatcattctcctctctgtctccattagttcgacgttttgatttttaggtgccacaaatgagtgagaacatgtgaagattgtctttctatgtctggtttaacttaacataatgagcgccaggttcatccatgttgttgcgaatgatgggattttattcttttttatgactgaaaagtattccactgtgtgtgtgtgtgtgtgtgtgtgtgtgtgtgtgtgtatacaccacattttctttatccattaatctgttcatgaacacaagttgattccatgtcttgactattgtgaattttgctgtaataaacatgggaatgcagatacctctttgatatactgattttatttcctttgggtatacacctagtagtgagattgctggatcatatagtaattttatttttaattatttgaggaaactccatattattttccataatgactacgttaattttcatttccacaaaaagtgtatgagttcctcttttttcacatctacagcagcatttgctactccttgtttaaaaattacatattattatatatattatactatatatgtgtgtgtgtgtgtatatatatatatatatatgtatatatattagtgacagggtcttgctctgttgtgcagtctagagttcagtggtatgatcaaactcctgggctcaagtgattatcctgcctcagcctcttgagtaattggtattataggcatatgccaccatgcccagttatccttttaacatttttttgtggagatgggaatttgctatgttgcacaggctggtctcaaacttttggccttaagggatccttctgcttcagcttcccaaagtcctgggattacaggcatgggtcactgcacccagccttattttttgtctttttgataatggccactctaatttgggtgaagtgatcgctcattgtggctttgatttccatttacattgtggtgaatgatgcagaacatttttttttacctgcctgttggccattcttgtgtcttcttttgagaaatgtctattcaggtcttttgctcatttttaagtagtattttgtgtgtgtgtgtgtgtgtgtgtgtgtgtgtgtatgtttttttttttttttgctattgtcttttttgagtttcttacgcaatctggatattaaccccttgtcagatgtgtagttgtaaatattttttctctcattttgtaggttgtcttttcattgtggtgattgtttcttttgctgtgcagaaacttttaagtttgttgaaatcccatttgtttctttttgcttttgtagcttattcttttggggtcttatccaaaaattttttgcctagatcagtgtcatgaagcatctccccaagttttcttctgggagtttttttcatttcaggttttgcatttatgtctttcatccatttccagttgatttttgtatatgccaagagataagggacttctagcttcattcctctgcaagtggatatccagctttctcagcactatttgtggaagagacggtcatttctccatcgtgtgtccttgccacctttgtgaagaatcagtaggttgtaaacacatggatttatgtctgggcatgcatggatttatttttgggctatcttttctgtcccatgggtctatgtgtctgttttcatgccagtaccatgctgttttggttactataactttgtaatatatttggaagtcaggtagtgtgatgcctccagcttttctttttttgctcaagcttgctttggctatttggggtcttttgtagttccatataatttttagaatttttatctatttccataagaaatgtcattgatattttaatagagattgcattgaatctgtaatattgacgtttttacaatattaattagtccaatccataatcgcagaatattcttccatttatttgtgccttcttcaatatctttcatcaatattttatagttttcagtgtagagacctttatccccattgattaatttttttcttaaacattttattttttgtacctattgatatttcactgtgtatagaaatactatggtttatgtactttaattttgtattctgcaactttgctgaaatcatttattagtttgaatagtttttcactggagtcacttgggtttcctacatataagactatactttctgcaaacatggacagtttaacttctacttttccaatttgaatgaatttttttttttttttctggtctagtttctctggttagggatattactgtgttgaaaaagaagtgatgaaagtggggatcctttccaagtcttatagggaaagccttcaactttttgccattgagtatgatgtaaactacagattagtcatatatggtctttattatcttaaggtgtgttccttgtaatcctagtgtgtttggagttattttgaattttgtcaaatgctttttctgcaccaactgaaattatcatatggtctttgtcctacattttgttaatgagatttatcatgtttatcaatttgcatatattgaaacatacttgcatgcctgggatgaatccaacttaatcgtggtgactaatatttttaatgtgctgttaaattcactttgctagtattttattggggatttttgcatctatgcatattagagatatttgcctgtagttttctttttctgtgctcttctctgattttggtattatggtaatgctgaccttgtagagtgattctggaaatactctctcatctttacgtttttggaataatttgagatagaattggtagtagctgtttacattattttattttattttttattaagataaggccttgccctgtcacccaggctggaatgcagtagtgctatcatggttcactgtagccttgaactcagcttaagtgacactctcatcagcctcctaaatagctagcactacaggcacacaccacgataactggtaaattattattattattttttgtagagacagggtcttgctatgttgcccaggctgatctcaaactcctggtctcaagcaatcctcctgccttggcctcccaatagtctaggactacaggcttgagccatcgtgtgtggctagttcttccttatatgtttggtagaattcagcagtaaagtcatgaggtcctgggcttttctctgatagtaaaccttttattactgattcagtctcaaacttattattggtttgttgaaattttttgttactttatgattcaaccttcgtaggttgtatgagtacaggaatttatccaatttgttggtgtataattgttcacaatagttattttatatttctgtggtatcagttgtaatatctcctttttcatctctggttttgtttatttgagttttctctcttttttccttagtgtggataatggtttgttgattttgtttaccttttcataataccaattatacattttgttgatcttttgtgctcttttattttttatttatttcttctatgattttttaattctttttctaatgaatgtatttattaggcttatatttaaaagatcatataagttttatctgaaacactggtttagtatctgcaaagtttgattagtggtttgggagttgtttacatactgaaaaacaagtttaaaaaatagaaagatataacataatttatatcataagcaataaaatgagatccttaaaaagtattgaaattatggaatgcttatcagaaaggcaggggaaagactttcccactgttctcaatcctcttctttttgcgggggtttaattcattcttgtttttatagttttctgaagtgcacagtcacattgcttatttgagatatttcctttttttgaagcaattgtatattgctcttagaattgcttttgatgtatcccataggatttggtatgctgtttcgaatttcacttttctcaagaaatttttattctcagtaaactatcgcaagaacaataaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataataataataaaaaaaaagaaaaaaaagaaaaaaaaaaaagaaactaccatcagagtgaacaaaaaaaaaaaaaaagaaatttttaaaatgtcatcaaatttcttaattaaacttttggttattaatgagcatttttacaaattttcatgtatttgtagaagttttgaagtttcttctattactgatttctagtgttatgtcactgtggtaagaaaaaatttgatataatttcaatctcttaaataggttaggacttgttttgtggcataatatatgatctatcctagggaatgttccatatgcagttgagaaggttgtatattctgcagctgtttattgtataaatttcatttaggtccatttggattcgaatgctgattaaaaacaatgtttctttgttggttttctgtgtggacgatcagtcagtttctgtaagtgagacgttgatgtcccctactagtattgtgttgcagtcaatctctcccttaagaactattaatatttgttttatatatttaagtgccccaatgttgggtgcatatatatttatgattattatattctcttgctgaattaatccctttatcattatgtaattacttttttgtctctgtatggttttcattttaaagtctaagttacctgctacaagtatagctactcctctcttttggtttctttttgtgtggaatgtctttttttattccttcactttcaggctatgtttgtccttacctattaattcagtttcttgtaagaagcatatagttgagtcttgtttcttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccatcacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaagggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagaagagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtgtcctcttttatttccttgagcagtggtttgcagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttgttgccttctgctagcttttgaatgtgtttgctcttgcttttctagttcttttaattgtgatgttagggtgtcaattttggatctttcctgctttctctttgtttctttatttatttagccactctatatcttttaagtggagaatttaatcaatttatattcaaggacattattgaagggtaaggacatattactgctattttaaaaattgttttctagttttcttatggatcatttcttcctttcttcatctcttattgtctttctttgtagttaagcgatttcctctagtagtttattttgatttcttgctttttattttagcatatttattacaagattttgcttcattgttaccatgaggcttataaaaaacatcttacagatataccaggtcattttaagctgtaaacaatattactttgatcacattaataaaaagtttctatattttaatccctcccccagcttgaatctttgacatcataatttatgtctgtttatactgcatatattttaacaaattattgtaattattatttttaacagtttcgtctttttacttacatacttatgatatgtgattcactcaccattgtttcagttttagagtattcttgtctatgtatattcttttaccagcgaattttatactttcaaatgatttcaggttactcattaatgtattttactttcagtttgaagaacttcctttagtatctaccttttatgtctttttttcttcaacttttattttaagttctggggtacgtgtgcaggatgtgtaggtttggtacataggaaaacgtgtgctatgttgttttgctgcacagatcattccatcgcctaggtattaagcctgacattcattagctgttcttcctgatcctctccatcctccatgacccccaacaacaggccccagtgtatgttgttcccaccatatgtccatgtgttcttatcattcagctcccacttataagtgagaacatgcagtgtttggttttctcttcctgcattagtttgaggagcataatggcttccaactccatccatgtccctgaaaaggacatgttttttttctttttgtggctacatagtattccatggtgcatatgtagcacattttctttatccagtctatcattgatggggatttaggttgattccatgtctttgctattgtgaatagtgctgcaatgaacatacacatgcatgtatccttatgatagaaggatttatattccttcgggtatgtccccagtaatggagttgctgggtcaaatggtattcctggttttaggtctttggggaattgccacgctgtcttccacatggttgaaataatttacgctcccaccacagtataaaagggttccttttccttcacaagcttgccagaacctttttttttttcactttttaataattgccattctgactggcatgagatggtatctaattgtggttttgatttgcatttctctattgatcagagacgttgagcttttaaaaatatgtttgttggccatatgtatgtcttctttgataagtgtcttttcatgtcctttgccaactttttcatggggttgtttttttcttgtaaataatttgtttaagtttcttgtagactctggatattagacctttgtcaagtggatagattgcaaacattttctctcattctgtagattgtctgttcactcatgatagtttctcttgctttgcagaagctctttagtttaattagatccaatttgtcaaatttcctttcattgcaattgcttttggtgtttttgttatgaaatctttgcccgtgcctatgttgtgaatattattgcctagattttcttctagggttttaggttttacatttgagtctttaatccatcttgaattaatttttgtatatggtataaggaaggggcctggtttcaattttctgcaaatggctagccagttactccagcaccacttattaaataggtaattctttccccattgcttatttttgtcaggtttgttgaagattagatggttgtaggtgtgccatcttatttctgagttctctattctgttccattggtctatgtgtcatttcttgtactagtgccaggctgttttggttgctgtaggcttgtagcatagtttgaagtcaggtagcatgatatctccagcttagttcttttggtttaggattgtctgggctttttgggctcttttttggtcccatatgagttttaaaagtttttttctaattctgtgaagaatgtcaatgatagtttaatgaaaatagatttgaatctataagttactttgggcagtttggccattttcacaatattgattcttcctatcaatgaagatggaaggtttttccatttgtttgtgtcatctctgatttttttgagccgtggtttgtagttctttttaaagaggttcttcactaggatcatgtcatctgcatacaaagataatttagttcccctcttcctgttgggatgctctttatttctttctcttgcctgtttgatctgtccggaacttccaatactatgttcaataaaagtggtgagagaggacattcttgtcttgtaccggttgtaaggggaatgctttcagcttttgcttatatatatgttatagatggctcttattattttgaggtatgttccttcattatatagtttatttagagtttttaacataaagggatgttgaattttatcaaaagtgttttctgcatctattgagacaactatgtggttttgtctttagttctgtttatgtgacaaataacatttattgatttgcatatgtgaaactagctttgcatcccagagataaagcctacttgattatggtggataagctttttgatgtgcagctgcatttggtttgccagtattttattaagaatttttgcatcaatgttcatcaagtatattgacttgagtattatattttattgtatttctgccaggttttggtatcaagatgattctggcctgatagaatgagttagggaggagtccttcgttttcaattttttggaatagtttcagtagaaatggtgctagctcttctttgtacctctggtagtatttggctgtgaatctttctggttctgggccttttttggttggtaggctagttattactgcctcaatttcagaactcgttatttgtctatgcagtgattcattttcttcctggtacatttttaggagggtgtatgtgttcagaaatttattcatttcatctacattttctagtttatgtgcatagagatgtttatagtattctgtgatggttgtttgcatttctatggagtcagtggtgatcccctttatcatttctgattgtgtttgcttcttctctcttttttctttattagtctagctagtggtatatctattttattaattttttaaaaaatcagcttctagattcattgatttttttgaagggctttttgtgtctctatatccttcagttcagctccgatcttggttatttcttgtcttctgctagcttttgggtctgtttgctctagttctctagttcttttagttgtgatgttaggttgttaacttgagatctttctagctttttgatgtgggcatttagtgctataaatttccctcttaacacttttttagctgcatcccagagattctggtatgttgcctgtttgttctcattagtttcaaagaacttcttgatttctgccttaatttcattatttaccccagagtcattcaggagcaggttgttcaatttccatgtatttgtgtggttttgagtgaattctttaatcttgagttctaatttgattgtgctgtggtctgaaagactgttatgatcccagtttatttgcatttgctcaggagtgttttactttagattatgtaatcatatttagattaagtgccatgaggcaattagaagaatactgtatattttgctgttttcgggtggagagttctgtcgatatcagatccacttcatccagagctgagtttaggccctgaatatctttgttaattttctgtctcattggtctatcttatattgtcagtgaggttttaacttcttccactattattgtgagggagtataagtttttttgtaggtctctaagaacttgctttatgaatctgggtactcatgtattggttgcatatatatttagggtagttagctcttcttgctgaattgaaccttttaccattaggtaatgtccctgtttgtcttttttttatctttgttggtttaaagtctgttttctaagaaactatgattgtaacccctgtttttttctgtttttcatttgcttggtaaatttttttatttctttattttgagcctgtgtgtgtctttgcaggtgagatgggtatcttgaagatagcataccagtgggtcttggttctttatccagcttgctgctctgtgttttttaactgggacaattagctcatgtacctttacagttagtattgttatgtgtgaatttgaaacttgtttatgtaattgcttcatagtgtcacttgtctgtgtacagcagtgtgtttctgtagtggctggtaatggtttttctttcccatatttagtgcttccttcaggatctcttgcaaagcaggcctggtggtgatgaattctttcagaatttgcttatctgaaaagcagcttttttctcctttgcttatgaagcttagtttggctagatatgaaattctgggttagaaattttttctttaaaaatttgaatagtggcccccaatctcttctggcttgtaggatatccgctgagaggtctgccgttattctggtgggcttctaattttaggtgacctgaactttctccctggctgtcattaacactttttctttcattttgacctcagagaatctgaggattatgtgtcttggggtggaccttatcatggagtatcttcctgggtttcccacagttcctgaattttaatgttagcctttcttgctatgttggggaagttcttctggatgatattctggagtatgttttccaatttgcttccattctccccatctctttcaggtaccccaatcagtcataggtttggtttcattacacaatcccatgtttctcaaaggttttgtcatttcttgtcattctttatttcgtattcttgtctgactgtcttatttcagaaagatagtcttcaagttctgagattctttcctccatctcttttgctattggtacttgtgattgcattgtgaaattcttgttgtctgctttttagctctatcagggccggttatattcttctctaaactggctgttctggctatcagctcctgtattatttgtcatgattcttagcttttttgcaatgggttacaacatgctcctttagcgcggtgaagtttgttattatccaccttctaaagcctacttctgtgtattcagtcatctcagcctcagcccacttctgtgcccttgctggacaggtgttacagtcatttgaaggagaagaggcactctggtttttttgaattttcagcatttttgtgttgatcatttctcatctttgtgggcttatctaccttcaatcttttagttttctgaactttgaatggggttttatggggacatttttgttgttgttgttgttttctgtttgtttgtttttcttttagcagtcagaccactcttctgtagggctgctgtggtttgctgggggtgcacttgagaccccagttgcctcatttttttcctgtacctggaggtgacaccagtgaaggctgtgaaagagcaaagatggcaacctgttccttcctttggaagctttgtaccagggcagtattgacctgttgccagcctgaatgcacttgtaggaggtgcctggagacccatttttggaggtctcacccagtcagccggaatgggatcagggacctgcttaaggaagcagtctggcaattttttggtagagcaggtgtgctatgttgtgttgggaggattctttctcttctggaccatttggactcttccaaagctcgcaaaatagaacagctgagttcacagaactgcagcgatggtgaccgtccctccccccgaaactctgtcccagggagagatcagagctctgttcatataatccttgctggagtggttgaagccccctcagagggtcccagaccagtgaagaggaatagattggggtcccatttaaagaagcagtctggccacaatctggcaaagcagctgcgctgcattgtgtgggaacctccctcctccagaccatttggattctgtaaagccagcaggctggaatgtatgcgtttactgaaccacagagagggtggccacccctttccctgggaacttggtcccgtctcaggcagactccagcctgctgccactgggtggctggaattccaagccagcggatcttaacttttgacgtgctgtggaagtggggcccacagaacaatgctgcttggctccctggattcagcctcctttctagggatatctacagatggggatcccagggccagagtatattaaactcctgggtgtctgtgtatgttttagtggctgttctgctgagactccacacagctttttgtgtcagacccaaggctctgatggcataggctcatgaggggatctcctgatctgcaggttgcaaagatccttgggagaagcatggtttccctggcagggtagcacaatcactcaccacttccttggctggggctggcagttcctttggctccatgccactcgtggttgggccttcaccccaccctgcttttctttgttcttcatgggtgaagttgtttgcctagtgagtttcagtgtgagaacctggatatttcagttgaagatgctgaattcacttgcccctttcatttttctctgagtgctgtggactgcagctgcttctaatcagccatcttggccccaggccttctgttgttttaactgaacatttttttatcattctctttcctgttttcttaacatatcaattataatttttaattattctttagtgattatagtagagttagacatatacatttaaaactaatccaagtccatttttgaaataacactatatcatgtcacaggtagtgttattatcttgcaataacaaaatattcctaattccttctttctatcccttttatcattgctgtcattaatttcacttataatatatatgtttatatgttttaataatcaagtacattgttattattttgcaaaaactgttattcattagatcaaagtacagaaaatttttaaaaattattttcatttattccttccgtaatgttctttttttttatgtagatctgagtttgtgacctatatcattttctttctttgtgataaacttctttatttttttgtttgcttttgtaaggaagatctactggcaacaattgccctcaatttttttttttgtctaagaaagtatttctccttcacttttaaatttacttttgaaggagaaattgataggatacataattctatgttggtgtttttgtttttgttttctcaatatgtcaaatattccactccactctcttcttacttgcattgtttcttaggaggagtttgatgtaatttgcatctttgttttcttgtatgtctgatgtttctctttttaatctgacctctatcaaaattttttctttatctctaatattctacagtttgactatgacatgcctagttgtagtcaaatttagtttttatgtcattgtcttctacacctgtggaataggatatgagggtggggctaaggagttgtctcactaacttgatgagaaggaagcccaaggcttatgaaaaaaagtagaagcagtaagaatgagtcatcacagcagcctgtgagactcaaggaattctgtataagaaggatggataacggttctctaagtaacagctattatagggaccagagtgttacataacctattacctcagggagaccaagagaaagtaaaatgaggtgttaccttttatgagactaactgtgcctagttatgactgatttagagcagctagactttaggagcaaagtcacccacatgaatctcaccaatcaacttaaattatactattgtgtcaatttaaatgtagtgtgtgtatgtgttactaagtacaacttactatgttgaactttattaatttgctaattcacaaaatatttattgaaaacttacatgctaggttttgttttaggtccgaggaatgcaataatgaataaagcaaaactacacattatagttggaaatgacagataatgaacaagtaaatgaaataaatctttatgaaataagtactatgaagaaaaataaagtcaagggaggaatgagaatgaatttgtgatgttctttcaattttgttggtcagtcctttctaataaagtggtacttgaacttgagtagatgcgtgggcaagtaatctaaataatgagtgctttaggtagagggaacagccagtacaaaggttctgaagctgacttttaaggcttagtctggcaagggaatgttgaaagttttttactcatgtgtatttgcttgggggttgacagatctctaaaggagatagtccctgggaatatttacgtcacatgaatgaaatatgaaacaatacagtggtcaagtttaaatacaataccgcacttcatttagtgactgtattttagtcaattctagattgttttgggaaatctgattgagaagaaacatgaaggcaaattttgcttttagaccaactttcttactcattgctctttttatcttctctgagtctaaacttggaattgaatcatccaatctcttttacttctaggaaaattttatagttcatactcttttgcatcatatttttcatggtaaaagtttccaataaaaaggcaaatgttggcaaaaacctcaagtcaaaagtcattcttcaatttgacattcatgataggaattgtgtcctagatgaagaccctgttagtaatgtgaaaaggtaacacgctatctggaaattaaagctgcttccccagtgtcaggggctgataaaatgtgattaatgaaggggataatggacttaagaaatataacaaaagagaacacttgtcttggatgaggcctgttttttgatgcatgctaagggatacaatattatccataatgggacttaatactaagtcattacatgacttcaaatagtgatgatgtggtcatgaaataacacagcatttttgttctcattaaacactcaatttgtgtaaataagacattatcatagtgggctatgaaaattggttttatgttcaaatatgtaccaaataatttataatgaaaagtgccagatgtagaataaaaggaaaaatttataaatattctttgaggataagtgttaaatcaatttggggaagaattgatcatgcagaggcattacttatgatttaagagcttaagttgaacaatgagaacacatggacacagggaagggaatatcacatactgtggcctgtcagggggtggaggctaggggagggatagcattaggagaaatacctaatgtaggtgacgagttgataggtgcagcaaaccaccagggcacgtgtatacccatgtaacaaaactgcacgctctgcacatgtaccccagaacttaaagtataataaaaaacttattaaattttaaagaaaaaatagagattaaactattttaaactaaaaacaaaagaagtgtttttaacaacaaataatttgtttcaagctatgtaaacattctgaatataaacattttctttccacctcagacatgaaaaaatagcattctattttgctcttctattgttttatatcacattttttaaacctatgacaaactagtttccatgttaagcctaagttgtgcattgggacagatatttatagaagctgcatgaacagttgaagaccattagaaggctcctggatgcttctcaaaagcaatttataaaagggttaattatacttttgcaagaactttgttgctttaaaatggtatcagacagaatcctttcagttatttaaacacaacctttgcgcacccagtttgtacctggaaccatgttttaggctttatctgtttgctcatttgaatgcttggggattcaaatgtattttactaacttctaagtttgtatgacaaactaatgtagtaaatgacctttaacttagtaaacaacctgaaatattaaaggtaattagaattttcttatttcttctttgtcacctctattttcttagataatgtttatttttacttaagggatgagaggcctgtaacttttcagtttaccaaatctaatggttagcatggcaataattttgtaatgcaaacagctctaaaatgttagtacgtgtgcagactgttgctattaagtagagtgtttagcatttctattcccaaaatgaagtttctttactcaaattctctttgataaagtaaaacaaatgccattaatgggctcttgactttttataggattatgattatttttattattgattacttattgctaaactactataaaattgtccaaccagtgattttcaaaatgtgtttccacaactaaattgctaataaagacttaatttgaacatctagtttgctcccccatttatattaacaacaaagaattttttctcctagttttataacaaatgatattagttacttaaaaatgaaaaaggatcaaaagctgaaaaccttagcctgcttttacttgaatagaacatggtagaaattactgtgatttcttaacaaaaagcttaagagaaacataattattagattggaaggtataacaataattttagcaaatattttggaaaaaatgtggcctctgaaatagaaaaggatttctacatgttatctcagtatagaatcctcttttatctatataagaatactacatttcaaaatgttatgtgtaaacaaattatgcatgttatgtttagaatatgttttctctgaacattcacaaaaagtgtttcatatactcttattattagtagaattaaattctattgtaatagagattacctttaaaacatatatttgattacactacaggtcaaatttcatttttagaaatataaccaatacatactttgaaagtgaataaatatacaattatatgcaagatcctttagtgagaacttatactcttcgattctaacatatatagcatataaaattagctattttaaatataaaggtctaaaatttttagattatgaattattcattactggaatgtattctccttttatgaccaacaaaacttagtgatctaaaagactataaattttttcaagaaatcacaacaagggaaatagcctatatttggcagtaggtagtacattaagcaaggaaacttacaagtgggactagaatagtgtcacaatctgaaaaactgtattcaaattagtaattttcaagaaattcatatgtaaaattaaaaaaaagtgagacccatgatgttaacaagacccttattgcctattcccaatacaatgatgtgtataattgctaacataattgtaacgtggcctcattattgcttgccttgcacaaattgatagagactgactctttacaagtctagctcaacgtaaaacctatttttaactttgtgaaataacaaacaataaacccaccgaaatgcttcaagcagttatatattaacacttaattaaatggcctcacactgtacctatttatgttttaaaaacccatgaattccagtgtagtcttttagtaacctccctttccttgaatgacttgataatgtgtgaggaataatttgtgcatgttcatcattatataccacccaattcagaatacaagaattcaagtgtttgagagaagcgcttgttagcatatattgattaagaaatcataattatttaattattctttagtgaataaattctgaatgctgttaacttatgtgtaatgttcaacaaaataggatcagtatacaaaccttatatccacagactgttgtattggggggtggattctcattctgactctaccaccaacgtttggaagaagaagaatgttatgtaaataaaagtgtggcagaaagagatttttttctttatttacttatggctagaaaagcttaatgatgttttagaagtgatattacacctcagaaaaggggtaatgcatctttaaaagctaaactacaccttctttacttttatcaaattctctataaatctttcagacagtttatttaacaaagtgtcattgaaactgtatagatgattgatatgacccatgtaaaatcaacatgaaatgtttgtaaatgtcagcaaaatgtgaccatctaaaagcatataaaaatggaggttctgtgaaagcaaaaaacaaacagaaaaatgtttatcttattctttgctttctgatatgctattacaaattcatagaagtattgtgctttatttttttgaagttcgtatcatcacaggcctaatttgcttttgacatctactttttcaaagctttggtgtcttattcattgggtatattttctctgttacctgtggaaaaaatattataggctcagaacttcttagcaagaagataattgttttggaatgtatcagcagaaccttgacctgaaactttatgcacaaattaaaggagactatcaacagagaaatgtcactgaagggttaccatctacacttggatacagaaaaccgttgttggttttttatttacttgaaaaccttaatgataaaaaacatgtgctataagatacagaataaaagagaaggatgaaataacagattcaactacaaatatcatataagaacaacaccttattgctcactctgaactgaagagtttctttatatttctctttgatgcatttttatataaaacaaatattattgttaggctagagcacattccttccttgggaattacgttgtacaaagcagaatgcatacagtgaaataaatgcaaatgatgatgggaaattaatagtagataataaaaagctaaaatttgaaaatctgtaggtactagtaaagtttccctattgaaatgaggaaaattttacagttggcaggggcaagaggtcttgtacatacattgttcatctaattacacattcttcattcctttttgcaaataattgcaggagtccacaattactgtggagaattgcagaatacctaatcatcaatacaggctgttttctatcacaatgattatatatatctttgcataatatatatttggtgtttggatgccctgctcattcttcagagcaggtaggaatgcttggtaatggtacaacaaaaccatgactaattggaaaacaactattttagatcctcaagtatacaaatttctctcaggagttatacctacctttgaggaagtcatggcaagataaaacaatacaagaagcatcttgggatcagtgcacatttctttccattttctttgctgtctgcatctctagaatggcacaatgattagttatgttcacagttatgacactaagttatagcaaggtctctggtcctgtgataaagatcctattttatttataaacttatatttataaaagtaggaaatagttctgacatattttgtaaaaatattaaaccacagggctttgagcataatataaattgaaattttggaacagattctgattgcaaagcactacgatagaaactaaccataatattcaattccatgaacattcctgttaattattgtactttgagaaagaggttagctatttttcaacctattatgtatgtattattatattttcttgtataagatgatattgaaaaaactgtactaaaatcatgagaatatatgtaggcacagatttagtttctgcttgtccattgattaatctagtaggagaaataattcataagtttatatattgattattcaaataaaaagtaagacgtgtaaatgccttaagataggtgtagaacatctacaaccacctgattttcaacaaacctgacaaaaacaagcaatggggaaaggattccctatttaataaatggtgctggaaaaagtgactagccgtatgaagaaaactgaaactggaccccttccttacaccttatacaaaaattaactcaagatgggttaaagacttaaacgaaaaaccccaaatcataaaaaccctagaagaaaacctgggcaataccattcaggacacaggcatgggcaaagacttcatgactaaaacaccaaaagcaataataacaaaagccaaaattgacaaataggatctagtcaaactaaagagcttctgcacagcaaaagagactatcattagaatgaacaggcaacctacagaatgggagaaaatttttgcaatctttccatgtgacaaaggtttaatatccagaatctacaaggaacttaaacaaatttacaagaaaaaaataactccatcaaaaagtgggcaaagggtataaacagacccttctcaaaagaagacaattatgcggccaacaaacacgaaaaaaaacttatcatcactggctgttagaaaaatgcaaatcaaaaccacaatgagataccatctcacgccagttagaatggcaatcattaaaaagtcaagaaacaacagatgctggagaggatgtggagaaatgggaatgcttttacactgttggtgggagtgtaaattagttcaaccattgtagaagacagtgtggcagctcctcaaggatctaaaaccagagataccacttgacccagtaatcccattactgggtatatactcaaaggattataaatcattctactataaagacacacacacacgtatgtttattctggcactattcacaatagcaaagacttggaaccaacccaaatgcccatcaattatagactagataaagaaaacatggcacatatacaccatggaatactatgcagccataaaaagaatgagttcatgtcctttgcagggacatggatgaagctggaagccatgattctcagcaaactaacacaggaacagaaaaccaaacaccgcatgttctcactcataagtgggagttgaaccatgaaaacacatggataccgggaagggaacatcacacactagggcctgtcaggggttgtgggtcaaggggaggaaaagcattagtacaaatacctaatgcatgtggggcttaaaacctagatgatgggttgataggtgcagcaaaccaccatggcacacgtatacctatgtaacaaacctgcatgttctgcacatgtatcccataacttaaagtaaaataaaaaaaaataaaaaataaatattcaaaaaagataagtgtagaaaaatatctgaggtaataggtatagatatcataaaaggatgagtaactttcagctgctaaaaacaggaagacttacacagaagaaaaatgactgaaagtcagtctctcaataaaaaaacacaaatctatactattaagaaaagaacataactgaactcaatattatacatttttcctaagtaccaattttgtacaactcataattcaaaactaaataatgttagaatttagtttgcggtttctctctgtaataaagtatatgagtgacttttctttctgcttttccatgacagtgttttttaacagtagttaaaatattgaattaaacttgaagtacagtgaatcttaaaattcagagacaaatacacaaatagcaaagtatttgataatgtcataaaattacactaaattttaattcacaaatggggatttttgttaaacttggcactcttctatcctttcaaaacaaacaaaaaaagaagtagagacagagatttacgtgaatgctaatgtccaaaaaacagacgagttacttttacttcttttgcaaaccctttgtcttgatacagtctggaatatttgcatgtttccagcagcttatcattgaaaggagcctgatgtgcccaccatatcatgtttagatacttgaagtagccaagactagagctttgaacttttgacattcctaagtagtggagctcacatccagataccatagcctatggcagctacttagaggctctttggagtaaggggcaccacatacaatgaaattgagtggaattttgacaatctggaaaagatgtacatataatgttgtggaatatcaagttgatgactcaggtcttcaatgtcctacgttgagccttactggcttttaaaagatggctcagagtatttattacatcagaaagagatccctccttttaatcatagtagagggtttgcattaatatatttgttttttaatgctttttcaaaatggatgacctgaagagtcttgtagttggaattctccgtatagtagattacaaatatggataatatgtttgttttgcctatatgccattgattttctataccatgactcttcaatgtaatcatgaaaactttgaaagactcactttattttgctattttttggcaagaagattgcaggtgttcaagactatgctatgtgatttttcatagctgtacaatcgatatgcaaacctaacattgtgggtgagataagtagtgggctacatgtatgaattttttggataataaaagtgggaaaggtactgcattagtccattttcatgctgctgataaagacatacctgagactggggaaaaacaggtttaattagacttatagtttaacatggctggggaagcctcagaatcatggtgggaggtaaaaggtacttcttacatggtggcagcaagagaaaatgagagagatgcaaaagtggaaacccctgataaaaccatcagaccttgtaagacttattcaattcactactatgagaacagtatggggtaaacagcccccatgattcaagttatctctgattgagtccctcccacaacatgcaggaactgtgggagtacaatacaagatgagatttgggtggggacacagagccaaacccattgggtccctcccacaacatgtaggtattgtgggagtacaatacaagatgagatttgggtggggacacagagccaaaccatatcattctgcccctggcccctccgaatctcaggtctcccacttcagaaccaatcatgcttcccaacagtcccccaaagtcttaactcatttcagcattaacctagaagtccacagtccaaagtctcatctgagaaaaagcaagtcccttccacctatgagcctgtaaaataaaaagtaagctagttacttcttaggtacaatgggggtataggtattgtgtaaacctgcagtaaacttttgcctgagtatctaggcatttccatacatcctctgaaatctaggtggaggttcccaaacctcaattcttgacttctgtgcactcataggctcaacaccacatggaagctgccaagccttgaggcttgcaccctctgaagccacgtccccagctctacgttggcccctttcagccacggctggagtggctggaatggagggcaccaaatccccaggctgcacacagcacagggaccctggacctgggcaacaaaaccgctttttcctcctaggcctccaagcctgtgatgggaggcactgccaagaaggcctctgacatgccatggagacactttccccaacgttttggtgattaaaatccagcttctcatttgttatacaaatttctgcagctggattgaatttctcctcagaaaatgagtttttcttttctatcacattgtcaggctgcacactttttgaacttttatgccctgtttcccttataaaattgaatgcctttaacagcacccaagtcacctcttgaatgctttgctacttagaaatttcttccaccaaataccctaaataatctctctcaagttcacagttccacagatatctagggcaggggcaacatgctgccagtctctttcctaaagcatacaagagtcacctttgcttcatttcccaacaagtttctcatctctatctgagatcaactcagcctggactttattgttcatatcactatcagctttttggtcaaagccattcaacaagtctctaggaagttccaaacttttccccatcttcctgttttctgagccctccaagtcttagaaagttccaaactttcccacatttttctgtattcttctgagccctccaaactgttccaacctcttcctgttacctgattccaatgttgcctccacatttccaggtggccttatagcagcaccccactctctgggtaccaatttactgtattagttctttctcacactgctaataaagacatacccaagcctgagtaatttataaaggaaagcggtttaattgactcacagttccacagggctggggaggcctcaggaaacatacaatcatggtggaagggaaaggaaacacattcttcttcccatggtggcagcaaggaaaagtgcagagcaaagcggggaaagcttcttgtaaaaccgtcagatctcatggaactcactcactgtcatgagaagagcacggaggtaaatggccccataattcagttttctcccctgggtccctcccatgatacatggggattataggaactacaatgcaagatgagatttgggtggggatgtagccaaaccatatcactaacttacctattgtttcatgttatcagtaccagaagtgagaagaaaattccaattctttctgaaaatgaatgattcaaaagaattactacagccatcctacattctatttggacaatattttaatctagaaatatatagtaaatgttgaatggctttgggttaagttatcaatgcttaggcactaatacagaatatggcaaaaagaaaatattatgaaatatatacaatcattgatttaaatttggtcttacaatattactggctacagtaatattttaagtagtcagctatcactgtggagctctcctctttctttgaatatatatgaatatatatgtgagtggcttagaaagctatctccattttactcatcttatttatttcttggtataccatctatcattggttcttattccatttttagcagactgtatcccacttatttaactacaacaacttcttttaaagtgttagaaactctattcattgttgtgtcagttaaaagcctactgagagtacttccaatttctccttgagtttcatgctaaagatataaactcactgaatttccagtgaagatatcagtagaataccattctatatgccgattccaagtatgttattcccagaaatttataggcctacaaaacaaggtcagatttgccatcagtgaatcttttcagcatattaaagacttgtattcaaagttcaacaaagcctattgtggggatgtaaattagtacggccactatacaaaacagtatggaggttcctcagaaaattaaaaacagaactaccatatgatccaacaatcccactgctggctatgtctccaaagaatatgaatcaatatgtcaaaagtacactgcactcccaagttcattgtagcattattgacaatagccaaatatggaatcaagttaagtgtctataagtggattaatggataaagaaaatgttgtatatatacacaatgtaatactctttgaccataaaaggaatgaaatcttgtcatttttagtaatatggatgacattatggaggatattatgtgaaatgaaataagccaggcacagataaacaaatattacatgatctcactaatatgtggagtgtgaaaaagtcaaattcataaaatcacggagtaaaatggtggttaccagaggctggatgatgaggggattgaggagatgttggacaaaggacacaaaattttagttagacaatggaatacattcaaggtttctattgtacgtcatggtgactacagttatcaacaatatattgtagatatgaaaatttcttaggaaggagattttaagtgttctcaccacaaaaaggatgtgaggtgatacatatgttaaatagattgatttagccattccccaatgtatatttaaaatattacattgtataccataaatatatataaaattttacttatcaaattctacaagagtccaacaaagcctaaaagacacttataatttgatattgtctagtatattggaaattaaggatttgcttctctatctagtccacacggtttacaggaaagataggtataaagtgataagtattagtagttacatgaagacatattttagtgtctttcattctaacccccagtcccaaatataacgctgttggtagaggagatatgacaataaatttatatcaagttagttgtggaaaatgaaaggggaatatgtcattacatcattcagtaattactgattaaggatttgccatgtcccatgcattctactaggctttcctaatgtggaaatatatgtatacgtctgtgtgtgtttgtgtgtgtgtgtgtgtgtgtgtgtgtgtattttctgaattctactagatctgtaataagtgctaatcaacagcaaatatttttttaattcaataaatatttgccatatccaaccatcggaatgaaaatttagcaatctgtttcttacctaaactctgtttgtttctatcctgacagatgctctcagttagatatttcattgatattctgctgtggcactgttaatcttattttgattgaaacagagttctggacagtaaaattgatgggtgcttatcagcagagtatcacaaaaaagtgataaaaagtcttcacgtgtaggtctgcatggggcaagaattatgactttccttaaacttgtaatttagaaaatacttattgtcattcttttagcactgtatggattatcaatctatttaagcacttttaatagctatattttgattgacatgtttcttgtcattttcaatgattttcttgcctaagcaacatatgatagagttttacaatggacagggcatttatctttacttttagatgatgtcttttctaacattgaagttgaatagctagtcatgtcacataataatatcatcagatccttgaggataaatcatatgtagcatatttattgtgtatgttaattttacggcagtttcattagatatggaatataaggaagaaataaattgaaaattaatacaatatggaaggatggtatgcttaatctaacacacacattagtacacatggacagagtggaataatggatattggagattccaaaaggtggaacagtgactgggaggtgggtgagggatgagaaattacctattgggtataatgtatagtatttgggtgatggttacactaaaagcccagacttcaccactctgcaatgtattcatgtatcaaaactgcacttgtactccccaaatctgtaaaaataaaagatacacattatatgtcaaaaacaaaagaggtttttttgcagtgctataatttagtcattagtctagccctttgctaatggctaaaataaggatttgacctaaaccaaataataaactaaaaactcagtaaacattattaatttgcaaggctcaacccccgaaaatatcattattatttttattgaactacaaactgaattaaaggtgttttttaaaattcagtgatgcagttagaactggaattgaacatatatattttctttaacaattaaacagttaacaattaaactagaacaaaaccagtatatcaaaatattttctaatcatgtatctcattcagttcatacattcctagcataaaatattttatattatccttcaaatatgttttaaagcaaagttagaccactgacaatgctgtgagttttacaaacagaatattttatttgtattcattgtttgagagaccttctcctttacttaagcttacaatagttcttaattagttaattgtaattaatgtttagattactgagtaacatagactatattgatatatagcttgtaaaacatcagtcttattatttggatttctgggagttttatttgctaagagaacttggaatctccttggtttaaattctgctgtgctttttcacctaggaaatagtttcctccctttatgcaattaggaatttactgcaggaagcataagatatgaagacctgtttactaataattcagtaagacagcatttaatattagagctgcatgtctctgaaagataaataaccaccccaaaagatatgggggtgcagtgtttttcctgaaatagagaagaaatgtgtctttcttgaagagagacagttgacaggcatcatacattactcttcatctagtgagatatattataataagaagataacctttagtgaacaacagttccgatttaagtaaagacttttgcccttaaaattctggttagataggtgaaataagttcaagagctctattgtacaacatggtgactgtacttaataaccacctattatattcttgaaaattgctaagggagtagattttaagtgttctcattccaaaagatgatataaacatgtgatgtaatacctatgttaattagctcaattgaacaattccaaaatgtatgcatatttgaaaacatcatgttgtacatgataaacctattagatttttatttgtcaattaaaaatgattaattggttaatttaaaaagaacaaaaatgaaatctagaatgaatgcggattattacgttattcactcttcttcagaggaataaatgggacactggaaatagcaagggctctctgagtggcactttcctgcttataagatgggaataacagctcttactacaacattgtctgggttggccctttgtaatcacaaagatccttatagaagaaagagggaggcaggagagtcagagaaagagatgtggcaatggaagtagtgatgagattgctggctttgaacatggaagaaggactgtgaagcaaggaatacaggcaacctctagaaagtagaaaaggtagggaaatggattatccccaagagcctctggaagaaagcgaatcctgttgacaccttgaagttaggttagtaaagcacatttcagacttctgaccccagaactataagacaataaatttgtgttgttgtagtctactaaaaaataaaagacccaagtcctctaagataaaaatgttatagtaataaatgatcactgtttagctataggacgcttctgtgggacatatccccactacactgcatttcttaaaataaaatattccagacattatttaattagttgatgagtaccaatagttattattctaaaaatctgtccctaaggattgtttttctgactataatacaattacagttagtttcttgatgataattcaattccatgtagatttaatagggtttataagtggaggatttgaagaaagggtggaaaatgaactctgaatgctggagcatttgacacattaaatatcgatagattagccttagcattgttaactgaacctaataacccatgagagattcttttgttcagaagcaaattaaaattttttttctcagagttaaattatagccaaggaggtgacattaaaactctccctttcatacatatttaatattttgtcctacagttccaagttttttaaaaatatttaacttctgtgggtacatagtaggtatatacatttatgggttacatgagatatttttatacaggcatgcaatgcgtaataatcgcaacagttaaatggggtatccatcaccacaagcgtttatcctttgtgttaaaataagctaattatattctttaagttgttttaatatgtataattaaattatttaaaaacatatttatattaatttttatgggtacatagtaagtatatatagttatgtggtacatgagaagtcttgatacaggtatacaatgtgaaataagcacatcatgtaaaatggggcatccatcccctcaagcatttatcctttatgttatagacaatccaactgaactcttttgattttttaaaaatgtacaattaaattattactgactatagccattctgttgtactatcaaatactaggtattattcatcttactgtatttttatacccattaactatccctacttaccttcctcccccatcacccactacccttccaagcctctgaaaactaccattctactctctatttccatgagttcaatttttttttatttttagatcccacaaataagtgaaaacatgtcatgtttttctctgtgcctggcttatttcacttagcataataatctccacttccatccatgttgttgcaaatgacaaatctcattcttttttatgggtgaatagtactccattgtgtgtaagtactatgttttctatattcattcatcttcatggacacttacgtggcttccaaatcttagctttgtgaacagtattacaccaaacacaagagtgtagatatctctttggtttaccgatttcctttcatttgggtatatactcagcatcaagattatggaatacagtagctctatttttcattttttgaggaacctccaaactgtcttccatagcggttgtggtaatttaaattctcaccagcagtgaatgagggtttcgttttcttcacatactttgcagcatttgtttttgcctgtctttggatataagccattttaactggggtgagatgatatctcattgtagttttgatttgcatttctccgatgatgaataatgttgaccaccttttcatatgcctgtttgccatttgtatatctgcttttgagaaatgtctatgcaaatatttgtcccattttaaaatctgattattagattttctcatatagagttgtttgagctccttatatattcttgttattaatcccttatcagatgggtagtttgcaaatattttctcctattttgtgggttgtgtctttgttgattgtttcctttgctgtgcataagcattttaacttgatgtgatcatacttatcaatttttactttggttggctgtgtttgtggagtattaagaaaattttgcccagatcaatgtcctgaagaagagtttccccaatgttttcttgtagtagatttatagtttgaggtcttagatttaagtatttaatctattttgatttgatttttctatatggcaagagataggggtctagtttcatttttctgcatatggatatccagtttttccagcactattatttgaactacctttttcccagtatatgttcttgccatctttgttggaaatgagttcactgtgtgtgtggagttgtttctgggttattcattctgttctattgatctatgttctgtttgtttttttgttttgttttgtttttgttttgagatggagttttgctcttgttgcccaggctggagtgcaatggcacgatcttggctcactgcaacctccgcttcctgggttcaagcaatttttctgcctcagtttcctgagtagctgggattacaggtgcccaccaccatgcccagctaatttttgtatttttagtagagacagagtttcacgatgttggccaggctggtctcaaactcctgacctcaggtgatccaccctcctctgcctcccaaagtgctggggattacagctgtgagccactgctcctggcctatgtaatgtgtttataccagtaccatgctgttttgattcctacagctctgtagtataatttgaagtcaggtaatgtaattcctccaattttgttgtttttactcgggatagttttggttattctgggtcttttgtggtaccatataagttttagaattatttattctatttctgttgaggaatatcaacagaattgatattggtattttgatagggatacattgaatctgtagattgcttagggtagtatggacaacatttgaacaatattgattatttcaatccatgaaaaggaatatcttttttgtgtatgtgtcctcttcaatttctttcatctgtgttttataattttcattatagaaatccttcacttctttgattaatttccaggtatttaatttcatttatggctattgtaaacaggattactttttgatttatttttcagattgttcactgttggcatatagaaatgctactgattttcgcacaatgattttgtatcctgcaactactggatttgtttataagttctaacaattttttggtggactctttaggtttttccaaatataatgtcatatcatctacaaacaatgacaatttgacttcttcctttccaaactgaatgctctttatttctttgtcttgtctcttcactctagtaagaacttctggtatgatgttgagtagcagtggtgacagtgggcatccttgttgtgtttcagatcttagaggaacggcttttactcttttcccattcagtgtgatactagctgtggttctatcgtatatggcttttattatgttgaggtatgttcctcatttttttgagggtttttatcataaaaggatgttgagttgttttgaattatttttcaacatcaatgaaaatgatcatacgattgttgtctttcattctgttgatacgatgtaccacatcaattgagttgtgtatgtggaaccattgttgtatccctgggataaatcccactttgtcatgatgaatgatcttttaaattcattgttgaattcaggttgttcgtattttgttgaggatttttgcatcatttttcatcagagatattggcctgtagttttctttttttgatgtgtctttgtctggttttggtatcaaggtaaactggccttgtagaatgagtttggaggtgttcccttcttctctcttttccagaatagtttgagtaggatggttattagtttgttgaatgtttggtagaattcagcagtgaagccatcaggtccctggctttttcttcattgagatactttttattacagcttgttattggtctagttttttatttcttcctggtttaatcttggtaggttgtatgtgtatacaaatttcacttcttctagattttctggtttattagcaatagttgctcatagtagtcactaatcctttgaacttctgcagtaccagttgtaatgtctcatttttcacctctgattttatttatttggatcttgtctcttttttttgttagttagtttggttaaaggtttgtcagttttggttaacttttcaaaatccaactttttgtttccttgatcttttgtattgtttgcttcatgtcaatgtcattatttctgctctgacctttattgtttattttttcctactaattttgtgttcagtttgctctagcttaccagttctttaagatgcattgttaggttgtgtatttgaagtttttcttctttttatggtgtaggcacttatagctgtatacttctctcttagtattgtttttgctgtatcccacaggtttttgtatattgtgttttcattatcatttgtttcaagaaggttttcaattttcttcttaatttcttcattgagccactggtcattcagcagcataatgtttaagttctgtgcttctgtagtttccaaaattcctctttttattgatttctagttttatttcattgtggccagagaagatgcttgatagtatttgaattttttgaatattttaagacttttttgtgacttaacatatggtctatccttgatagtgatccacgtgctgatgataagaatgtattctgtagctattatataaaatgatctataaagatagattaggtttatttggtctatagtgcagattaagtctaatgatactttgttgattttctctctgaaagatgtccagtgctgaaagtggaatgtttatttctctgactattattgtattagggtttctttctctctctctttagctctaataatattccctttatgtatctgagttcttcagtgttgagtgcatatatatatatatatatatatatatatataattgttatatcctcttgtttaattgactcctttatcatgatatagtgaccttctttgtctcttcttatagttttgtcttgaaatcgatttagtctgatatatttatagtgacacctgctcttttttgttttttttattggcagggattatattttttctctgtattttcaccctatgtgtttctatataggtgaagtatgtttcttacaggcagcagatcattgggttcagttttaaaaaatctattcatccactatatcttttgattgcagtttattttgtttacatacagtgttattactataaataaggacttactcctgccattttattatttgttttttgatggttttgtgatcctctcctccttctttcctttatttctgttttgcttttagtgaaagtaattttctccggtagtatgattaatttctttctctttatcttttgtgtatctattttatatatgtttttaaatttcaggtaaccgttaggattgtagatactattttgtagcccattattttaagctgataacaacttaatactgtttgcttaaacaaaggaacaaagagacaaaaaaaaggaacaaacaggcaaaaacaaaactaatgaaaactctacagtttaactctatccctctgatttttaacttattgttttttctatttatatcttcttgtactttctatgtcttgaaaagtttttgtagttgttatttttgattggttcattattgagcctttccacttaagagtagttaacataccacaattacagttttgtataatattctgtatttttctgtgtggttactatgaccagtaagttttgtaccttcagatggtttcttgttgctcattaatgtgcttttctttctgatgaaagtactcttttgcatttcgtgcaggacaggtctggtgttgacgaaatccctcagcttttgtttgtttaggaaagtctttatttctccttcatgtgtgaaggatatttttgccagacatactattctagggtaaaaggttttttccttcagtaccttaaatatgtcatgccactctctcctggcctgtaagatatccactcaaaagtgggctgccagatgcattggagctccattgtatgttatttgtttctcttgctgcttttagtttttttcttttttgtttttctttttttttttttttttatgtcactatctcccattcacacatcttgctacttttaggatcctttctttatcattgatctttgggttgttttgaaactggaggggttcccttatccccctcacagggcatgtgacaggggtttgtcttgcttctttgatgccctgctgctcaaattcctagggggagcagacagccaggcaggtcttgaggagcatttttgggcttcgacccatgggcagcatctagggagtgtttacagctccagaagccccagtggccatgtgttacagtgtgctctttcagcttagccatccgcaggcagcttgtgttaatcagctcaattagatcctctgccttattgcaaggacagagggctttctgtatgtcgagttttttgccctcatttaccagaaaaatcagatcatacgtgggcttggagaatgagtgcaaggttttattgagtggtggaagttgctctcagcaggtggttggggagcagaagggggatggggtgggaaggtggtcttccgccagagttgggccacccagcagctggactctcctctgactgaattcccctcagagaccacgtcgtttcgctgtcgatggcctgtcggcatctgcctgtgtgttcttctgccggtgtgttcctctcgacatccagccatttgtgtgtgtgtgcccgctagggtcttggggtttttatgggtataggatggggggcatggcgggccagcgtggtcttggaaaatgcaacatttgggcgtgaaaacaggagtgcctgtcctcacctaggtctgtgggcacaggcctgaggatggagccctcaacaggtaccccaccgttttctacccagcacttccctgccccctgttccatatcagtttgattattaagttccttgaggtagtcttttttggggttaaaactgcttgatgtcctataactatcttatacttgaatgttgatatctttctcttggtttgggaagttgtctttatccctttaaataaattttctttccttatgtttttcgctatcttctttttaagccaataactcagatttgtccttttcaggtaactttctgggtcctctgggcaagcttcaagttttaaaatcctttttgcttttgtctcctgtaactatgtatttcaattggcctgtcttcaagctcactatttctttcttcacctttaccaatcctgctatttaaagattctgatgcattcctcagtatgtcaattgtattattcaactccagattttctgcttctttttaaatatttcaatatctttgttaaatttatctgataaaattgtgaattccttctctgcgttatcttaaatttctatgagtttcctcaaaacaactattttgcattcttgttctgaaaggccacgtatctctgtttctacaaaattcattcctggtggcttatttagttcattttgtgaggttgtgctttcctggatggtcctgatgccagctgacattcttctgtgtctggtcattgaaaagttagttttttattgtggtcttcatagtctgggcttgtttgtacccatcgtttcagggaaggtttttcatgtattcaaaagaacctgggcattgtgattaaagccatatctacatcaaggggcatcccaagcccaataatgctgtggttcttgcagacttgcagaggtaccaccttggtggtgttggataagatccagaataattttctcacttaccaggcagagactcttgttctcctcccttactttctgccaaacaaatggattctctgtctgttctgagcttactggaggtgggggtgaaatgatacaagcacccctttggccaccaccactgggattgtgctgggttagacctgaagccagcacaacactgggtcttaccaaaggtctactgtaactctaccttgctatcacctatgtccactcaagaacctgaagctctacaatcagtaagtggtgaagccagccaggcctgtgtgtttcccttcagagtggcaagttcccccaggctcagagtacagtatcaagtacataaaccccattccaaaaagtaagaagtactgcctcttgtaataattttggatttaacttacatgacaaatataggccttttatctgttttaaggaaatcatgattttgcaagttaaagaagatgttagaaataaaaaccatataatcttttctgataaaataattccactaatgttactatgtttgtattccagctaatggttaactcaggctactatcatatggcagtagaatataagattgtctaatggtcaatatttgatgtatgtaaaaacacagtttatactaaatcagttggataaaccatggaaaatagtataaaattaagagatacaatatttatttcacataaacatgggagatattcttattgttcctgtgtttttctgctttgatcattagccaaattttcacgttagtttttattatgggattgtttaggagcacatatatgaaaattgcagtgatacagagaaagattagtatgtcttctctacaaggcatgcacattcgtggaagtctacattttgatcctactcatgtttaaaaactagacaaattgccacctcctttggtctcctcaggtcaaatatttctctcttttgtgctctgtaattcattgtttatatcagttctattgccatttttgtacacatatatctttctcattagattatgaactctgatcctgtataatacaactttatattccccacagcagctaatccattgacttgtaaatagtgagcagtcaaaatgtttttatggatttgagttttgtgagtcatttgctgaatattagcatcaggacacactcacacaaacacacatgcttataaaaattccatcttctccgtaagtaaatatcctatataaaataaatgagagaagaacatttaaattctctagttgttatctgtataccaagtatatccctatataaatgacttcataatggctgaaattgaaaaatttaggcagaaatagctagtttctctaaggatcaccaagtatagaagatttgaataattagcatgcacacattaaatcacttatgcagatgactgcttcatacgagagtaattcagcacaagtttacattgtgctcacagttgatcaggacctgaaatgaatctggaagatccctggagctcatatcatgtacattcctaactatagatacaacgttgaatggatgacagataattatggagccctttgggtctaattcttacaaggcaaagttcctttgacttttttgatcaattttctctgttgccagtttgttaaacatgcaatagcatgaattattattttattcatccatttgctctattataagctattttattgttaaatacactcaatcattgatgctattttgtaaatggtatttttgtcgcatttaaaaattttaaatcatgatcaactggtaaagactttagacagaaagaatatgtcttattctttttttgagctctgttgcacattgtggtgaatacagttaagaacagagtattttaccttttaaaattgctgagagtaaatttcaaatattctcaccacaaaaatgtatagtattttcagtaaacaatatgttaactagtttgatttaattattccacattgtattcataaattataacatcactttgtaacccataaatttatgcaattataaattttcaacttacagttaaaattgttgcatcttcttataaaaatacaaatacataaaaataaattctccagtttccataaattttagaagttttgtatatgctcagatgatacaggaagtggtggtgtattttagaaaaagagaggaagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgatttccacaatggttgaactagtttacagtcccaccaacagtgtaaaagtgttcctatttctccacatgctctccagcacctgttgtttcctgactttttaatgattgccattctaactggtgtgagatggtatctcattgtggttttgatttgcataatgtggcacatatacaccatggaatactatgcagccgtaaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaacatcacactctggggactgttgtggggtgggggggagggagggatagcattgggagataaacctaatgctagatgacgagttagtgggtgcagcacaccagcatggcacatgtatacgtatgtaactaacctgcacaatgtgcacatgtaccctaaaacttaaagtataataataaaaaaaaaacaagcataaaaaaaaaaaagaaaaagagaggaagtgattgtgtggggcagaacaactgtccttggtccaagcagcatctttaccagccaatggttgtcttggaattctaaaataaatatatacctgatgttaataaataaattcatgcaaaatattgtgataatcattgatctatgcgggagatagcttacctcattatatcattcgaattgcctctttctttttattatatgtggtgtcttataagcaaatcatttttcctttgggactactggaatggcctttgttctcagtatgtataatggataaaggtgtcttgtaacaacttatatcccataaggaaaatgtagcattgcttctctttgcttctagaaatagtgctaagaaagacttgccaggctgtgtgtggtggctcgtgcctgttgtcccagcactttgggaggctgaggctcaagtgatccacttgagcccaggagttcgagacaagcctgggcaacacgatgaaaccctgtctctacaaaaaatacaacaattagctgggcatgatggcatgtgcctgtggtcccagctacttgggagttgaggtggaaggattgcttgagcctgggaggcggaggcttcagtgagccgtaatcatgtcactgtaccccagcctcagcaacatagtgagacctagtctcaaaaaaaaatgcagtcaggaaaagttatgagtatcttgtttttgctacatctaaagctttcaaagtgttctgaataagccactctagactctgacattttcaccactctttctctatttttgtgcgtgtatgtatacatgagtgtcatatatgtatgtacacaccaaaaacacagttatatgtatattttttatttactcatatgtgccatgctaaacatgtaattgccttctatttgcttggagggatgatttgtaatttaactactttgtctggctttgctgaagctcagcaattattctgtatctctactgtaactttaaaacattactatgagtgggagaagggctgttgaattctcaccactaaacatttgcatcaagattaagtaaaatgttaatctctgctaaactgatttagctgaatagaatctatcaaagtatagtcatagtttcctaagcgtgcttggggctctgcagatgtgcaaagaaataccatatggaagtggctttctccatggcacaagtggtatggttttgtgtgttgtggtgtgtctgttggcattgttggcagttcagcaccctgggaaaggcattgctttcaaacatgagtaattgatgaattgtatgtaatatgcaaatgtgaatgcataaatctcctgaatgacagcttaatttatgtgagcttttaagaatgtggtattagattttaattaagtatcttcaaaggcgctctgacttattcaggtttttggctgctgtctttagaaagaagtgggtgaaggtttaaatcataattttacacacattattcacatttttgtactcaatggtcattgtttcatagaaaaatcaagatatttaaagtagaaaggcatttgtctttaattttaaaaacattgcttttatattacagtggttacagttcatcttatatgatagatacaggaaagtataagtgatctgaaaattaatgtcttaaatttcaaatgtaatctttgagcatatttcagatactaccgtatattttactatgcaaaattaaacaatgacaactgcagatgaaatttcttagcacatattgttgggaggttaatacagtgtatgactttcaaagtataattatcttaaaaataactgaaagagttgatagagatacagctgtctccgtccactttattcttagataggaagtatgtataaatgtagctctgcatgtgtatttttttgtgtgtgtatttttaacctatatttgataatagtttttcaaaccttatataatatacagattaggaaaaaagatattaattaaaaattataaaatttacaagcattttttcctctttaatctttctatgcaatcaggtaatgaattaaaaggatatgaatgtaatagatccacttaaagtttgctgtaaatgctgttaattctttacaaaatatattccaagaggacactgcaagatctcactcatatatggagtctaaaaagttgatctcatagaagtagaaagtagaatagtgattgccagagaatggggagggcaggctaaaggggactggagaaagattggtcaatgggtacaaacctacagttagataggaaggataagttctggtgttctattgcttagtaggatgaccagagttagcagtaatgtgttatatgtttcaaaatacctagatattctcatcacaaagaaattataaatgtttaaggtgataaatatggcaattactcttatatgatcattacactatgtatacatgtattgaaacatcatattgtatcccataaatatgtacaattactatgtcaattataaatttaaaaaatcttccaaccgatttatagtttatagtaaatcacattgcctataagtgataaatataaaaaaaactcttgatcagtaatgaattatgcctaccttttaactgtttttcccacatatttgttttctcttaatttattttcaagagcttaatttttgactacagcaacaattaagctatacttttttacttgaatgtgtttctcctctgatgtatcattgtagtggttaattgcacaaactttggaattatacttcatagttcttaaatgccagctctgacactacctgctgtgtgaccttgggcagagcaattaaccatgtctaagtttctggattgctgttagaattacatgacttaatacaaaacacttagaagagtgcctggcacctggtgagccctatgcaacttattgttattatttatttccactggtcccaccataccctcatttttacctggcaggactgtttccctgctgactggccccaagacaacttaattgccattttcatgattttgtctggaatgtgtctaccatgtatactctccctgtgcaggttctattcaatcttgagacctaaggatcccttttttttctatgaagtcatcattgactccttcctctgaactagctccattttttgttagttttcttctatcacagtatttttttgtttaatcatttccatatttatttttgtttataccaagcttacaactgtgaaacttgtagtccacttacttagtttctgtctggtatgttgacttgaaaattacatctagtgtgaagttccagcttcctttacctaatttgcctttatctaggtttgctatatcatggagatacaggatgtttcaatctccaagggagatggccatgcacaattctcctcttcagactcctgctattctggttctcttacggttgagactgtttctttccactctgaggaggggcttttctgtttattagaaattaaagatggaaaagtcatttgcctcatgttgaaaaatcaactcatacaatataatatatatagtcagacagataagggctacaattctggtcctgctgtctggctttcagcaagttagcctctctgaggcttaacttctcaccttaaaatagggatagtagtaccaatttcatggaactatttagagaattaagttgatgtgaaccttagcatagtgctagacatatactatgggttaatttaccagtatttttcttcccattaatcatctagcaacagtaacaggacttataataatgggctatgtgatgggatcaaagctattccttaaccaaaatattaaacacaatgccagtgaagagtttgtccaggagcagtgtgagactaagttttgtaatttcttctctaaagggaccagaatatatagacaccaattttaacatatactattattttttaaagtagagatcagtatgcctctcttctgtacttttaaaatcagaacatagaagctagctaaacataaactcttaggttgccccaactttcacagaggaagccaaactattcaactatgggcacattggaattgtactcactttaaatgtaatcaccctggttgtagtcatttcaacgctagcaaaagcctattatatattctttcctgttcaatgttgtgaagccggtataacattttctgtaatgtaagtcaacttacatttgtgtataaggtgctattccaggaacggtggtaggcttaaagatgaaattagtaagtcccacatagccctggccatgtgtgcctaaggtggtgaggagatcttgcagagcattttgcaccagctaggtggtcagtaaatatttatttaatttgacaattcaattcttagtggatagagcttctttgcagtgcatgttaacatgtaagactgttactcatactcacttttcaagataatccttttataaattatagtcttatattgcaaaacacttgatgagattttaatcaacttttcttttacttcattagatgcagcttaatgacaaatactttataaaaataatacggtgtttaattaataaatggtattttaattgcaaccattcttgccaacagcatataaattggaaaaataaattttgaacttattataaaagtccaaaaatatttctccacgaagtaaaaggtgcaaaatatcttcaaattataaccacttttcagtacaaataatgtagaagtttagagtccagcagatgtgcttttgagttcttatactagctctgtgacattagctgtgttatctaatctctgtgagccttagttttctataaattggggacaataaagtctacttgcaaagttttggtaggtattatacttattgtatctatatctctatctatcactcatctatcacactttctagatcacactttatatttcaatgtttccatttattgttgcttctacacaatcaaattcagctcagataattttatatatgcatcatttttaatagttaagatgggatgaatgaaacataagaagaaatatttaaaaggattatagtcattgttatggaaagaaccatggattggaagtcagtaaatgtgggttgcaatcatggtttttccctagcaaactgtgtgatcacagataggcaagtcgttttaccccactgagcttttgcttccctatctgtacaaataagaatttccactaactcttgtctatggtttcattcagctttaatattcttggattatttatattctttggctcttgagataacatagcatagtgagtcagtgtgctggatctagattcagatttactgggctctaatctcagttccccagagtaatagcgttacgacttggccaagtcatttataccccttgaaccacagtttcattatctttaaaatgagtatggcaaaaatagctaaaagtgaggattttaaatattcttaccacaggaaatataaatatttgaagtaatggattactcattagcctgatttgatcattccacaatgtatacatgtattgaagcatcaccttgtgccccatgtgcaattattatttgtcaattaaaaataaaataaaactttagaagtatttaacagggattgaaatcattgagaagttagcatggaaataacaatacatatttcacagtgttgttcaaagtattaaatgagtcaatatatataaaaaattcagaaaaatgcttggtacatagtaagtattcgctaaccacgacatataatcattacctaacgatacagaagtgtgactagtgaaatatgttcctcttatttcaactcctgatgatgcaagcacatatctataaggcaggcagtcagtggctatagccagtaatccagcatgatactttattcatctattcccatactgagatcttattttgaatctgcgtagaattgaatgatcttaatttacactaatgttatgttttcttgtaattttaggtatctgttcataaatttatatcttaatttccaaagtatttgaagataagattcatacctcatatttcctattgcacctcattcatatcacctgagattggactttgtatctagtagatactcaaaaataattgattgatgacatagattttaatacttctctagatagatgcatttaaaaaaatccccaaagttctcatttttaagtttaataaaacctcaggcatatatttatggaagaatgtttcctgaattatgataaacaaataacaatatcacataatatggaataatataaattatagatttttttctgttgtacaacatggtaactataataatatactgtatacttgaaaattgctgagagaagattttacacgttcttgcctcaaaaaaatatgtgaagtaatgcgtatgttaattagcttgacttagccatttcacaatgtaaacatgtatcaaaatatgattgtacaccataaatatatacaatgttttacttgtcaattaaataaaaagattataaatgatctcgcttcataaattacattttagtctaaaccgcgttcactgtcacttttctaaccgaatttttttaaagtaatatatcctcatacattatcttcctagatgtatagtgctcgttattgtgcattaaaattggaaaaatattgtcttgttggtagaaggagaaaattactctggataaaatttggaatttattgtttgtaattatttagaatgtctacctagtatgatttacatgaggacttaaaataaatagactagaaagttactagaaaatagcgtctttggacaaggaaatttactctgtcattaacgtttacttaagaaaaagctatgtaatcaaagccaggaagtcacagtatactttggaaggaatgctaaactctttttgtctgccaccatttggacgtagttgcatccatgtgcttttttattcactctttaatttattttgcctcatacattttaattagagaacacccacattatgtactacgcacatcatgtaggttataaaatgcaggcaagctattctttattttttcttcctaatcagaagaaatagcaaatatagatatctcctttttgccttattgggtcaacatacaactcattctaagcaaggttttgcatgtctcattgtgaaaacaactgagctcaggttaattttgcagaatgtcatagagaagaaaagagggtaaacttccactactgatccttgtgctggaggcagttgtggatcttagagctatgtgttatcactggtatcataatctggaagcaaaaggggagatggctctaagaaatagaaatggacagtcagtctgactgtatctgaataataatgccaagatatgtaacgatggaatatagcaactgcctttggccacctttgttcaattctggaagaactgatcctaatccagagacatgcttccctttgagttatccgggtttgagatggctacgtgttggttatatcctatgatgtttttctgtggcttaaaattcaccttcctttattcgataagtctgggataaggcctaggtgattataatttttaaaagctctataggtaattctgatgtatagattgagaattatcaggttaaccttctctgtgataaaaattgtctcaattttccatttaatataggatgaagctgctttcccattgagaggctactaatttactgaacaaagtcatgcagtaaacattagaatatttacgttggtggactttttgggtagagagttatagcctatttcttgtacaagtaggcagctcctttgagtggaggcatgagtatgagtacagatttggaggattagagtttggaatcattagccaaatgacaacataaaatacacaaaatcagcctaattatcagaaataatttccaagtagaagtaaattgagtttcctaacatatgttatgcactcagtaaagagaaatcctgagaatagttctacatgaaaataaaactatagcctaaaatgtgaaaaattcagtctgtctgtcttcttactacctgctgtacacaatgcttttacgccagatatttcagtctcatggacatacattgtacaggacacacttcttaacagaatggttgaagttttcattactcatataggtattttgttgcaacacagttgccacctcaaaatgttaaacctgtgcaggaaggggagttttgaaatacaaggacctctaattttattcaacaaaatgtttgcttctatatgaaaagagaaacaaacctttattttggcagcaaatgtttccaaaggaagcaaatgttttagtgactatggccaacataaatgttttcttttaggcagttaaggcagacaaatattttcatagcattttcagagtgtttccaccctttattttcacagagagagtctctctccttcccacccatcaccctatggaaatattttcagaacgtattttgaccatgaaaacaacaaaaacattttgcacgtgttgtctttataagagttaaaaggatgttctcaatgtttaagaaagagaaaacaaaatgacagtcgggatgcgacagttgaaagaatactaaaagcagcaaaactgagttctagcttttactctgctacttacctgctgggtgacctttaactgacaactcacctttcttggctttcagtattaatcaggaagatgagggagttccattaaatgttacccaatctatattttgcattttcttttcataaaaatgatagtcatataattaatacatgtgccttttaacatcaacataccctatctatatttttgtaaattttattgtgttaaaaacacttaatatgagacttatcctcttaacaatttttgattatataagtttgactattttagatagcccatgtatgtggaatcctgcagtatttgtctctgtgactgctttatttcatttagcatatcctcacagttcattcatgttgtcacatattacagatcaaaaacaacccatatcatacttttagtttttttttaatgacaaattcttccacgtctgtgttttgttttaggaatagaatcagacaaataaaatacacatagtattctaaaacctggataaggtcttgccagctgtgtgtactgatctcctagcagctatggatgaattcaaactttttccactacaacacaattacctctaaaaccaatagaaaatatttcccttcttgcctcagtttcccagatagaacaagtaaaaatacttgaatatattttgagttcattttttatttaaacttgtttgtagattcagaaggtgcatgtgcaattttgttacaaagttatattgcgtgatgctgaggtttgagatacaaatgatcctgtcacccaggtagtaagcataatatccaagttagttttccaaaccttgctctttcctccctcttccctctagtagtccccagtgtctattgttgccatcttcacgtctgtgagtacctgatatttagctctcacttataagtgagaacttgcagtattttgattttctgtccctgtgttaattcacttaggacaatggcctccggctgcatccatgttgctgcaaaggacattatttctttcttttttatggctgcatagtatttcatggtgtatatgtaccacattttctttattcaatccactgttgatgggcacctacgttgattttatgtctttgctattgtgaatggtgctgtgaggaacatatgagtgtatatgtatttttggtagaatgatttattttctttggatatatatcaagtaatcgaatttctgggtcaaatggtagttctgttttcatttctttgagaaatcgccaaagtgctttccccagtggcttagctaatttccattcccaccaacagtctgtaagtgttcccttttctctgtagccttgccagcatcagtttcttgttttgtttttttgtttttttgtttttactttttgataataaccattctgactggtgtaagatggcatctccttgtggttttgatttgcattttcaagttaaatttgacaaataagaaaaaagtgaatataaaccctaaatgaatcatgaacagtactttttcactataccaccatttgtggttcaatactattaggttcccttaggagttttgagtttaactcaaacagtactcataagaggtttaagaaaaacaaaataccatgcccaatatgtactatatcacggtgaaagcaaaaagttagaattcagtaaactataccaatttagcagttctaagattcttaattatactactactaccattaataactgccaaattattaggcaggattgttaaagactatgtaccaggcactactctgaaggcatattttctctctctcatgtatatgtttgtgtacatgcatgtgtgcatgcatatgtgagtatgtgtatatctttattacagctctgcaaggtaggtgttaatacttccaatttacagattaggaatatgattcctatagacattaaaagacagatggtatatgtgagctggtatagctgatagataataggttcagaacatggtctgcctgatagtaaaataatttaaactacttatgtgtttgttacaaaacagcggcagataacaacttcataataataatacattagatagatgaagggtgtgagccagacagtttcatcaattgctagagaccttttcacttgaacgctagaatgagagtaggatagaagcaatcttgattgccctgaaaaaatgatctgtccagagctaggctccaaagtcaaactctggtcataattcttggagatctatttggtgccgtatgacttagaaggccacaaggtgctctcagcccattattgtgtcctaaatggagagagtactggccctgctctggcctggccattgttgatcgctgcctagttctgagtggcagtgaaacctctatgattgcaagagagaaaataatttaacaaagttacaggaagatgtagctatgacattttatgtacatggaacaagcctttaacaaatgaaggaaagttgcagggagtgacttttaaaaacttacttgtttttaaggactgctcttgatttataattgcttctaaatgagaagttttcctttctgggtcaacgtttagaactcactaatagatactgagtggctactatgagcccaacccagcactctttttttctcagcatcaaaggtggatataagtaagtgtaaagatgcaggcttgctcaaagaaattgaaatacatttaggaaaatgaaaggttaattaaatttttaaatatgggagttacatgacaatatccaataaggatgtaagaaatgtcacatggtgaatgagcgcaatgagcaaataaaatgtttaacttcagagctctgattgggcatctaactctgaaccttgaaatctcatcaatatgtttaatcttgtatttttttggtataaaccactgtgcataattcttttccatctctgagtcaacaagtggtaccttaatcttctttcatgtcatcttggccttttcagagactcttattttatgtcaatgacatgaaacttaaaaaccaaaattatcaattgcaataatgcaccagtatttacaaatatgagtagtatataaatattcaaaatgggcattgcccaatggaaatataatgtgagtcacaaatgttacatgtagtttcaatatttctagtggtcgcatttaaaaagtaaaaagaaacaggtgaaattaattttaacaagttttgtttaacccaatatagccaaaatatcattgcaaaatataaaaacataaaatattaatgagatagtttgcattattaattaatttatttatttatttattttggagaccgagtcttgctctgtcacccaggcaggagtgcagtggtgcaatcttggctcactgcaccctccgcctcccagtttcaagtgattctcctgcctcagcctcccaagtagctgagactacgagcgcctgctaccaggcctggttattattttttttttatttttattttttagtagagatggtgtttcaccatattggccaggctggtcttgagctcctgaacttctgatccacccgcctcggtttcccaaagtgctgggattacagaggtgagccactgcatccagactttttttttttttaactaagacttcaaaatccagtgtgtattttacaattacacatcacaatttagactcgccacatttcaagtgctcaatagccacatgaggctgatggttactttattggtcagcaaagctatggactcatacagacaaataagaattcaagctgtgtggcctggcatggtggctcaagcctgtaataccaacactttgggaggccaaggcaggaagatcactcggggccagtagttcaagaccagcctgggcaacatagtgagatcccatctctaaaaaggaaaatatgaaaattaacctggtacggtggtccatgactctactcctagctactcaggaggctaaggcaaatggatgaatcccttgagtcagcccaagggtttgaggctgcactgagctgtgattgatcataccgctgcactctagcttaggaaaaaaaaaaaagaaagaaaataaattcaagttcaagctgtgaccttctgcaagctatttaacctacctttgattcatatttcttttctaaaaaatggaacaatagtacctaagatgttacaataggtacaataatataccgaagatgtaggtactattattgttccattttttagaaagtggaacgatttgggactaaattaagtgattatgtataaaggctcagaacagtgctttgcacataataagtgtgacgtgcttattatctttacactatggaatataaagcaaggcatattttaatatatagataaatttctatattttgtttataactattattatcattgatttttaaaatgaaaaacaatttgaatgaaggaagtgaaacgtttatctaaattaaaaatgtgataaactaattctttaatacataaacccatcttcagaaatataataaactaattcttttatactaattcttttatattctttttatatcagtatccttaggacgtttttcttgggctagtataaatttccagattcagatcatcttacattattagaaaatatttttactctgacatttattcaatagtgtaggtatagaattctagattctctaatcttcttcctggtatgtttgtacccaattttcagtaacggggaggggaagggtcctcaaatttgatatgtaaacttttacttaattctacccatgtaattgcataggatgatttttcttaggttctttcaatgtaaagagaagggaggggggacctttgagctctgggagaattgttatgatcaccctgtaaaagcaggagggattccagtccaaagtttggttcagatgttgagactgatgatgccacacacacacatgaaaaagctatggaaaggtttattacttacagaattcaggtctctaggaagagcagggcaggcctctcaagcagaacctaaatggcttgaaagagctaggaaaggagactggaatgggtgtttattgcggttaggtgatgctagcccaggtaaggattcacttgcaaagaggattgcatggtttgaatctcccaccaatgccaaagcagggagcccccaagctttcttatcagcttacctagatgtgggacacaagaggaggaaggaaggtgaaggttaatgaaattaatcctcattacaggaatgctctggacagagggcagaacatttaagaatggcttccactttcagaaaatgttacaaggggagattgtcttaccaaggtctgagatagagaaagactttaatctgaaaactccaattttccctttgtatggctaatgatgaggtcaggagtatgtaggtgattctactactaggaaaacttattaaatgacctttcatatgcagtggctctcagagtatgagagatcaccagcagcatcagcagctccagagaattcattacaaatgcaaattctctggggatgaggccttacaatattggttttaacaacccttcccgtgatgctaatacttgctcaaatttgaggactttagatatagagtatgcaagctaatccatgtctgggaaggagctggagaactaaatggcacagtatcatgggcataatgaagaaaaggacttttgaattttttattggcaggtggaagagacaggaagacaggtcatgtccttgggaagagcaggtacaggggaagattcctggagagaggagaggagccctacaacatggcaggaggctagggtctgaggaggaagagagctggtgagaatttccaagggatagggatggttaaaaaggtcttaagatggtgatgtgtggcactctgctttatgctttctatgttgtaatattcctctctcagtcatgagtggtcagtagaagtcaattatactggccaggcgtggtggctcatgtctgtaatctcagcactttgggaggctgaggtgggcaggtcacttgaggccaggagttcaagaccagcttggccaacatggcaaaaccccatctctactaaaaatacaaaaattagccaggcatggtggcacatgtctgtagtcccagctactggggaggctgaggcacgagaattgcttgaacccaggaggtaggggttgcagagagctgagatcgtgccactgcactccagcctagggaacagagtgagactgtctttcaaaaaaaaaaagtcaattatatacaaccaagctgtagtagacagtggggactgaaggagaagaagtcaaggaggaaaaaaattaccattactctgtgcagagagaggatgtctttttaattttttcttatcaaggcattcagtattcactcactgactgactaaataaatgaaatgtctgagtacttctagatttatggaagggacttaggcctctttttttttaaaagaagtaatttgttgccttaagcatatcatgtattaaaaataggaataaaaatatgtgataaactaattctttaatacaaacccatcttcagaaatataatcaactaattcttttatacataaatccatcctcactaaacaggcaaataaaattaagtgaccatagatttagcatatggctgaagagtaatatttgccaatattttacctcacaggtagatgatttataagaacattgacagttatgttcctggcatagatgcattattagcatgttcgtgttttggaaaggcattctgtttctgcacatcatgttatctgtaccttccaacgtggaaacacacttgctgtgaatcattcctcagaattgttcttgcttaggaaatgagcagttactaaggagtcatctttgactttatgtttttactttgaatctttaaatttaagtaaatctttcaaagaatcctacctggcttatagttatgaattgccataaattttaatgaaatatcaaattatgtaaagatgacctaaaccattttactcatatgccatattttcccttcagaacttgaatatttattttttgcctgcctgttgaatagcatttctctcaaaagtgcaagattttttttattctaatttaagtaaaataagttttgtctttgttgttcttaatctagaatgttttgatttgtatattacttttaaatgttgtttctggttatagaagctgattacttagctgctttgtatttcttttacccgtgtacttagagacctttaaaaataatcagcattttaaatattttcatcatatcacaagttatatctggcaacattgtgcattagctaccaacatatgcataggtactttacttattttgaaagttcctgccaacgttatataaaaacaactttggatttgaagctgtctatcttcaatggaaataaggaaattgttgcttgaagtgcaactggtttagcatgctattcattgacatttctggacaggtaacatacagaaagagaattcctgataatgtaagaaggtaaatggcagaactgagacccctaagggatgagagttgctgttaagttcccataacccattccaatcattccaattgatattccctcccactccaaaaaaagacaggaaaaactgatcagtatggaggcaagtgaaagtttccatggtatgatcacaaaaatcctgtaatattaaaccacaaggcatagaggaggtcatttagcctaatatcttcagcttataattatagagagatggtattcagaagggctagataatttacccaagatcacagatataatagtgcaactcccaaatctgttgtaacactcccatgcatctatgctcattttcacaactgctaaatgttaagaaaaatggcttttcacgtgttttagtacatagacgtgtttttcatagttaaattttgccaaaatcagatacattatcatgtcttccttcatgatttttcattgcaattgtaatggttttatcttcaatcacataaaaaatgaaaacgacaagctcaaaaagaattatttgatttagaaaatattaccacaatgctttcctttcaggcaatcatgtgctggtaaatgtttaacaactggctgagggtggagcgggaaggggtgggatggagccatgataggatttgctgatttctgtggtgtgaatactgccgccatgaccaatttcaagctaccaacatgaggtcctcaatgtgaagttgggagttgatgcacacaattggtgcctgcaagtgggtacaagctggttttatcacatcattgttttcagagcacaaacaacaaacttgaggtccaattggggatcttttttttatttcaattgagtcttgattttcagtttatatacatatacgtgcactcatacatttgacccctgaattttatgtttttgtctacattctctttaaatccaatatacactggtttggtaatagatcagtatgtcttcgccgattaaaggcatttgaattataacattttgttcataggaggatgtaaaccctaaccttaatcagtgcatttcaggggacaagaaccaaacaaaagagaaggaatttcctaataattcatacatagcaagctttgagaaaaatctccatgcctttgcctttgactttaggttctaaataatatgacatacttccctaaggaacatcttctatctgtatcccacacgcctactcactccttcaagaaataaaactgtaaaaaaaatgtcgtttaaagtagaatcctgaaaaataaacagtaagcttctagtgtaatgtttcagaggaaagaaagatcttgtattcattgcaatttatctggaacacaacttatttgactttctgtggtcctcttgaaggtgattaatcaccaattttagagcaccaagaattgcacaatattaatgtttaattagcaaaagggaagcacctggagtgtggaggaagcgactctaagattagactatatgctttcaggttataacaaaagacaaatttaatgaccatactatttatccttagggaaaatatagttgataagttgttagatagcctcaactcaaggagagtacaagcagtaagtaaccttttgcatgcttatttcattgccgactttttaccaataaataccaatgaggcatatttgtgagctttcctatccttccaacacaaagggaggcagattgtgcttgggatgatgagacagatctatgacaccatcagtttgatgtgtcatgctttgcacttgacatgttgcttctcaccaaaataaattgatttgtcttcccccacctaattatcttcttcgtcaaccttcttgtattcaaatggaaaagattattctaaatgcttgcttaacacctttcctttgctgccacttttattttcataattacccttttatgaaagtataaaaagatttaaaatgattattcttggaaggaggcccaaggtgaaatcctgttgtatttaatgtgtaaattataatgtgtgcagttttgaagaagggttttggtgaaatgctcatgtaactgcaaaaatttaaaggaagctgtcaaagagtttacactctttcatggctaatattaattggaaaacatctcataatatgttatatctgaaggataaatggataagttaaacacagccattaactttctggaagacaggaagataaaggattacaatagcctctcagcaagggtttaggaaaatgcaaaaccccttcctttcctcagttactttgaagcatatttgaaatgattaattttcctgtgaatattaagagaattaaagaattgagatttgaatagaaactgtgttaccttgctgaccttgctaacaactgaccttgcttccccacttttcaaactgaacttgtgtatggcttttctgaccaaatgcatttgaagcaaaaacaatcctttcatctaaatagaaaactaaaggaaaacattttttagtttttatatcctgccaattttcaaaaaatctccccttctaaatttagattgtaaaaatattcagtgtgcttgtctcctgttgtgctaattggtaaccctgccacctgttaattttggtattttaaaccagttagagcggggttaatgaaaaaaatcaatatatttggatcttatttctacctccaaaactccaaagaaaactcacaaaagtgcttacaatagcacagtacaaagtatcctggcaaaacattttgaataatccttctttccttctttccttccttccttccttccttccttccttccttccttccttctttctttccttccttcctttgaaccaagaactatgttagacacaatcaaggaatactcacacggtaagatacagtccctactaacagtaaacttaagagtctggacaagtagctatatcttacttaatttaatggtttacaacaggtagagtaggacaaactgctcactttaccatggtgctgacattaaataatttaagttgataaaatgcctaaaacgatgaaagtgctgtgcacctgcaggaaatgcctggagctggaaagggtgttagggtgaaggttatcacaacttctctcatgaagtggaggtttcattgttcagcctaccccattgatggacttcaattgcccaaaatattttagaactttaaatcttcagtggttttcaccttgagaaatattatttattctacaaaaagagaaacaatcaacatatttttttctactgaagactggcttttaaattctatttaacaattatgtaataggaacatgttcattgcatttgtcttagaaaaagtcttcactgatgactacttttcatttcaggatataaaggtgtatttttatctcctcttgccttcagggaatgttatttaatagcatatttgtgatcttctagcctgttgtgccaaaaaatagcattccctcaaagcagaaaatagataattcccagaaggagaaagtccaaagacaacaaatacatacaccgagcttgtccaacccacagcccgggggctgcatgtggccagaacagcttcgaatgtgatccaacacaaatttgtacactttcttaaaacattgtgagatttttttttctcatcagctatcgttagtattagtgtattttatgtgtagcccaagtcaattcttccaagtggcctagggaagccaaaagattggacacccctgacatacactaggggattctgtcacagaaattattttctaaaacagtaattatagtaatactaatataagagcaatggtctaaagtcatgacacaaaataaaagcaaaaacacacaatacatacatagtctcatttctcatttataaatagaattccctcatgtaaatttcaaagaggtttttaatatgttttctattctcttcccttacccatatttgaggataaatgttgtggttttaggcattgaaccgtgaatgtaagggtgttttacacagtggacacatttactgacagtaaaactacggttttacaatttgagctgtatcgggatatttttctaatcctgaactgaactgatcactaaactgtatggttagtcatcaggaacatacccatcctatccttataggcctgtacatctgaacaggatttgaatctaaagttaactaatgtattaactagtggaatttgatttcatgcatatttttgtatagaagtcagcttttagttacattgcccttttggcaacattgtctcgttgttaggtaggaactatatattcaaattatcattagtagtatcaaagggactctcacatgaaatgcagatccacaatggtcatggccactgttgatttcatttcgcttcagaaaattgcaaaacattccatggtgagtcaaaagtactcataagggaatgtaaaaaagcagaatcttaaataagcaaatgttattgttttattctttctatggttaaacaaaagatatgttataagtatggggggaaatatcacgcttttaggaaaaggttgtcttttatagaaagggtttatttatattgagtcattggaaactagaaggaaataggaaaataatctttgtcagctattggatcttggtaggtttatttacttaaaatagtgagagaaaaggagattttaacaaattgagtaactgaaagtgatactgctgttgactaggaaaagttaaaaaaggggaaaatataacttcagagacatccttgtaaaaacatgatcaaagtgattgtatagtgctaccactattatatcagatgactattcatttaaattggaaaattttgctcaaagatgttcacatgttggttgtttttttttccttttgtacattattacattatgaaggattttagagagaggagctgccaattcctcataattctttgagtcaaatcattttggtaccaaatagcagatgaaactgaagcatagaggtcaagtttctcggggccacaaagtgaatcaatggcataggtaaattcaagcagcatttttgagtccacagtttatttctggtttgttgtattgtgctacctcctggaaactataatttagaaagaaaaattactttttaagtgtattagtttgtatccagtttcctggaatcaattgtcttaagatttacttgtgatatttgaatctacccaaatttacctgacttcaagttcaaagtgagggagggaaaaaatagatcttatttatttatttatttatttatttatttatttattttaaaatttccgtaaaatacacaaaacataaagtgtaccatcttaactatttttaagtgtatacttcatttgtgttaacaacattcacattgttgtacaacagaactctggaagtttttcttcttatgacatctaattgctcatgagcatgtccactgccatggcaactttaaagatcttcatgctcatttattaaagtctagcaatttatccataataataccataatgaacaacaaagaaaattatgatttacttctctatttcccagtcacctgctataatctattgtgtccttgatgaaaatcatctttattagtttgaaaaaggaaagaggtgtggggcaaagattttcgggggagagatgcctcacaaatgttttcctgtcaaagtaaggaatggggaagggaaaataatgagaaacaaatctgcatataaacatgaaaatgtattgcagttatattaagaaaaattacagttgtgaaattaaaatgcaaagcttcaactccttaatcctgccttagaagtaaggacgtctcaaggtgcaaattaagtgtgtgttatagatgtaggagatagttgggagtgttggtagttctagtattcaggtgaggaaagttttgcaatatgtaaacttcatgatgtatccctctagatttttttcctttggcattcaaaatgatttcagtggaaaatgtaagtctattagtaactgcaaacatagcaacaatactgtcttataattgtatataacttttaaaaatctgtggtaaaatacacataacataaaatgtatcttcttagctatttttaattgtacagcttggtagtgttaactatattcacattgttgtgctgcagaccactggaaatttttcatcttgcaaaactgaaattctatagccattgaacaacaactccccatcttcccctcttttcaacccttggcaatcacattcttactttttgtttccatgaatttgactactttagatacttcatgtaagtgaaatcatatggtatttgtcttattgtgacttcactatttcacttagcatgatgcccaaaagtttcatctatgttgtagcatgtgtcaggattcccttcctttttaagttgtttagcacttgtaaccttgaaaccagtgtttagatatattgactaattacacgtatgtatcagctggagaaaatgctatggcattttgcacaaactgcatgttttatttatttatctttcaattttccataggaccaatcctgcacctcaatataacttaaaatagaaattaaaacagacagattagaaagtgaaaatacgaagtatattttgaagttaatgaattatctgcatctgacctgaactataacatggttataatgatcaaattcatagattattaagtttacatctctaatcctaatgtggtaaaaaacttctagaatagtgatgtgatttgcctgaggtcgcacagctcaatatggccaaactagtatattagatttctgttgctatacaacaaattgtgatggacagcaactgaaaataacacccatttattgccttgcagttctgtatgttagaagtctggatgggcttgactgggttttcttctagggtcttacaaggctgaaatcaacgtggtagccaggctgggctcatattggaggctctgtggggaataactgtctcaaaagctcattgaaatttttggcagaatttaattcattatgattgtagggcttatgttgctgtttccttactggctgtcagtacagggctgagtttggcttactaaaatcatttgcattccttgttgtggccccctccatcttcaaactggtagtggtatgttctttgtttttctttgcactttattttatttatttattatttttgagacagtatgttgctgtctcacccaggctggagtgcagtggcacgatcatagctcattgcaacctcaaactcctaggctcaagtgatccttctgcctcagcctcctgagtagcgaggactacaggtgtgtgacatgatgctcagataatgctttaattttttgtagagatggctgtcttgctatgttgcgcaggctcgtctcaaactcctggcctcaagtgatcctccttcctcagcctcccaaagtgctgggttataggcatgaaccaccacacctggctctcctctccacttttaaagggcttacatgattagattggctcacctggacaatctcattttttattaacacagagtgaactgatttgttattttaatcacattggcagaatttctcttgctgtgtaatgtaacataatcttgggcatgatagctcatgatattcacaattctattaagtagggctggaaatcttgtcatggagacaattttgaaattctacctactgcaactgggattagaactcagatttcactttaagtgctttccactgcactaccttgaatatctacgattgttcaaggtgcttttattttaagattagttgctaatatttatccatgaagagcaaaagtttaaaaggagtttaagtcagcaaggaaactgccttctgagtttattgattgaatgtgtgtgcttccagactgtatcactatccatagagactaatgcaggcaggttaatagtgatcagctttctgatggacttgctcaagttcttaagatatcctaaattgtaatattaacaccatgctgctgcattttctgattgccattcaaacttgaaatgctaactgttgaggttatcgtgagattatagactgacaatattacaggctgatgattattgatgagacttcatttatcaggcatggaaaacattattttggctagttgcaatagtatccttcttgctggtattaacatgtcctttgcaataaccattaaagaaagtctgtttgatgacacaaaggaaaagtcagtgacctttcaaaaaaaaaaaaaaaaaaaaaaaccagcggcagttacagcaaattacacagaagccttcccaaggcagtggagcttaacaaaacatggccccaggaaacctgataccttgagatgtttcttctgtggtcaaatactacggttagcatgtagtaaattcactagtttagctggagtggaggactcatttaagtagtaattggagaaaaggcaaaaaagatatattggagcaggttaccagactaaatcatttagactttattttgtatgcagtcagaaatattgaaggttctggagcaaaatatgacataatgaaaggggtatttcatcaaaattcattgcagtttatttagaatggattggaacacagtgaggcaacctgttacaaataactagggcatgaagggatgaaggcttgaattagagtgtcagaagtaaaaaacatggagagaagtgaaatattgcaacacatattatgatggaacaaaaatattgaagactcgaaatgaaaggagaggacaaggagagaagtttgtagttttggcatcggagagcattcctatattgctgacagaacaggagaagggtggaaagtgggatttgagggaagaatacgcagaatgtaaggcactagtggaatgtgtccaaatgtgaatgttaatttcttatccattcatcataagttttccacagtgatactttgtaaactcaagaataactttgttttacaaacattgtgtctgacagtgatatgatacacaatagaaggggaaatatttatttaatttgattcagtttaagatgtattaatgtgcggctgggcgaagtgactctcacccataatcccagcattttgggaggccgaggcgggcggatcacttgaggccaggagtttgagaccagcctgaccaatatggcaaaaccccgtctctactaaaaatgcaaaaaattagtcgggcgtggtggggcgtgcctatagtcccagctacttgggaggctgagacaggagaatcacttgaacccgggaagcagaggttgcagtgggttgagattgcaccactgcgctccagcctgggtgacagagtgagactctgtctcaaaataaaaaaaaaagatttactaaggtgcattgattctactgatgttaacaggaattacacaagcagaaagagaaaaggttgctaataattcaagtcatacactagcatttatgttataaaatcattgttaattatatgaaggtctttattagaattcagtgaatttaggacaaaaagtaaacttgtttaaaggtgctaacatcagatttaaagcacatttcatttaaatagggaacagagtcaagtaaatgaagtataaaataccttcacagttatacttcctgtcaagtgtgtagtcaacccataaattgtctatgccatcagatttcttttgtttttgaaggaaaagaaacagaaattcagtattagtgagagaaagaagcatcaccattttaaaacatagctataaataattcaatttattataattataagattaatacataaacatgggtcgttctacttgagccttaacattttaatgcatgacccattgacaagtggaggttttccttcatccccctcaacaatcttatgttaatttccttaacttgcctgatactaacgaaatgctggtgttgatgctcttagtatatctacgcttaagtttgggatatgcgtataagatctgaaaagggtagaaaatgctaatagaatctaaatgatcttctctctggtgtgtttttaattctttgtattgatcactcctgaagacatgatgaaccatactttaagttcccatgaaccaagagctgattgatgcccagtttaacataagcaccattttatgagagttaccatagtgatcaggttccagttatcagcttgaacaatttaatatatgattaatgttaattgcccattttgcatggatgacttcttcctggttgctgaattggttgctgctgcctttgatctagttggaaattcaatccagtgcaatagttaggcaagtgatctgtttgccagcacagaaaagatggattcagtttgctgtgaggtcagagtttgtttctcttcataaacactggaaggtcaggtagagtttagctaccattggcatccttaaaatgttgtaataaatgtcagacctaagagatttttattaatccacacagcagttggaagtcttactgttctggcaaaataaagagattcttatttaatataacgtgcacattgaaattcagagcagcactttcatagtcaggtaaacaacgccttcaaagctaatgtcatttttggttttctggcttctaatgtacgctaaacagtgacacattcaggtactatctcaagggattttaaatatcagtgataactctgaaaagtaaatcccaagtcattggtaatggctttcacttcaggaattcaattgcagtggtttttacaagttgctgctaataccacccttaactaccactatatttgcagcaattttcacagactgtcctgggatgttataagtgtttctttaagaagtaggaagacaagctttcattgaagggatgacataaactgtgattccttgctgaatcaaggactgctcatatgatttatattaaatatctttaaagcttatgacatcattaattaattaactggattttttctttggaacaacaaaaatcactcttactcagttgcttactccttgaatcacaaatgacatgaaacaaaaataaattcaacagtcaaatttagtaatcttaatgaatgatgtatgagctaccttctctattgctcaacttggaatagatatatcacagaatgtgtcctatcttattgacactagaagacttgctgaaattctctcttagggaattgccaactctacaaagtttgtaaacttcaaggtaatgctctgatggtaatccacttcaactgcagaaatatgaagtactgttaatatatattttaagttggtttatttttcaatctcaggaagctgggtgagtatttcatttcttctaaagaagtttacagaatgacggggaaatcatatgaggataaattatgttaagggatgacctgggcccagagaaattatgattatttagtgtaatttccctttaaataacctagaaatattacacttaatgtgaattctataaagctgaatctctccaagatttagctgaggtatttattaagtttgactattttatggggttgtttgccttgtaccataacaactttcctttacagtgtacatgagtgatatattggcagagccatttggatgggaactttgtaaaaaggcctgttttattttacagactacaaataaccttgtaattaaactgaaaacaaataattgccaagaaacaattatcatttaattaaagagtaattacatggttattcgtgccctgtaaaataaagcattactaagatcagtaatgcaatcaacattttagtagaagcaggtgctacaatgatggacctttcaacctatgccgattaaattgtcatccaaataacagttacctagttaaaccaccacatgtttatttgccttgattaatatgtgaatatctgcctgatgctaatacagctcttaaagataagaagtatggcaagatcatatatcaagaaagatccttcccaactttttacagagtcctccacaatctttcatcgtgttgtcaggttcgtgttctttaaaatgaagtgcaggaatgtctaggaatgtcgtactatggagaatcagtaggtctaatagaataaagctatcttatatttgtatgtaggtatattgactataaagcactttcacaaacttcattccaattaatttactcttggggcccaagtctttgttccaaaattaaaaacaaagaaatctgaatgtgatatttgatgactgataaatgtaaacaagtttggaagcagggatctcacaaccatactcactaaagggtcaatcagaaattttaaataacagggcaaacacacatctctataactagaccacaagctcctgaaaggcaaaacttgttctaggttctcacaatatatcaatgaaaaaatcaaaccaaaatctttgccctcgttgaggttacattttaccctctgtgtcactgatacctagcattataccacacacacgcttaatgggtacctagtgcatgtttgtttactagatgactgaataagtgatatcgttactgcctatgtgtgactacaggggcctttattccttaagcagatcttgaagcttgtagggcttctaagtgaataagacaatgggatctatccatagccttctttacccttgtacacagtcagatttgagttgatcatgttttgaagctgctatagttattgtgaagttcaagatttaaaaacacaattatgttatgattaaatgaaactggctctctgttcttgtgatcaaagagaccagagtaattgaaggaatatttggaaactgtacaagcagtgaaagattgtttcctatgtatattaattaattgttttaattaactttttgctggatcttactttctgctagaaaccatgagaattgcttaggatacagtaacaaacaaaaccagacaagtatgctaccttcatggagcttagattccagttggggagactcacaattaatcataccaacaacataaaattatgaactgagatgaaagttaggatggataatatggtcctcctggattttataacatggggaatagatagtaccaagccatttgtgaaataagctgtgaaaccatttttttttttttcaaatcttcacctttaaggtagaactactggactaagaggcctctaatgcttcccaagcctgggtcagattgttggaaaagagttgcttcagatagtgagaattgaccaagaaatttggaacagaactagttaaaccttatggctttcaaagtgtactgttaactgctggcagtcatatggctcatcacgtggaagtagagggagcatcaggctgcttagttctggaggcagccagtctgaaagtgttcatgagaatggagatagcactgagatgtttacagcggacaaatacaaagactaatcaggtgtgtttaaataaagttagtaggcttgagttctgacaaatagaaggacacaaaaaagcatttagaaagtatagatttgatgaagcttattcgataaaataatgtgtctttctctgatgcctggatatattccgatgaacatttttcagtgatattgggatcctttaggacattcgaagtacataggatatttctgcttccagcattccttaaaagagtcagaaagccataaaatagggcaaaggcaaacacggtaaaacactgagttaaagaaaataaattatggcccagaatcaagtagaaagaaggagaggagagtccatttataaaattgaaacatcaaatgagaaaaacagaatcttttgcgctagattgatatataatattgatgtacagtggaagaaaataacactagcacagtgtatgaaaaatgaactgggtaacgatacctccgtgtaaggttgctagaagttgtttttcatttaaaagcagagtttgtcttacattgatggatcattttgctactgcaaagttgatagagtgaggtttaacttaaatttctttgtaaaccaaaagtcattttggggtatgttctctatctgaacctcatacatttttgctgctaaaattatttaatatagtattttgcagtattttgtcaaaactcatatcattcagctttgtaaaatgcatttctactaaaaggcaacagcaatatcttaggcaacattagaaagtaatatttgaaatatattgggtgactcgagaataacttgatcctaatgttctatgacttacaagtctcttcatgtagtgacagctttaaaatgatattttcagtaccctaactctattacggtacaagatggaggcaacagatactgactttttatttcattattagcatttgcaattacagtttctgaactgctaatgggtgaagaatgtacaaatgcaatgggttaggttaatgttataagtttatcatcaactcattagttaaaaacaccaatcaatccgagagaaaagacagcctagactgcaaaggtggcaggttttgttagtgtggccactccaagagagtgaactgcttgttatacagcttggtttaaaaactacataggaaaacaaaacctactgagggtggtaaccctttgttcctcgttggctcccagcagctgtggaaatgctaataaacatcagcttctattctacatctctcagctctttactattcacctctggcatgctgggcagagacttaatcacttcacattctatataatcttaattctgtgagtcactatctcagatctcagaagcatttattaatacttcagatcaagcgtagctttaaaagcaggggtaacttagggtttctcacacaacaggtaagctgcattgcaaagtgctggcctgtaaatggaatctaaactaaaattgatcccttatggcgctaatgtttgccataacaatggtggaaaatttagcggaaagtaaagaattggtctcttagtaatccacgaaaatagtctttaatgtaaaattctatcacttttggcaattaaacaagatttaaaaggtaaatattgcaagtgatggttttctcaaaaagagtacatttttaacctttatctatatttgtctgtttttcaacagttcaagacccggcaggccccctaagcgttctttgggagtgttgcaggaaaatgcccgccttctgacccatgcagtcccaggcctcttatcgccaggacttatcactccgacaggtaataaaatccatctgatgatcagccatgtctcttcgtactgcccagcatttgaaataaaccaatattgatctaactgccttgtccttcagagcttttcaagctctattagaggttacattactgaatttttttatgtgttcgtgaaaacaaatttttttacttgagcgacaaatcaaatggacgtgattttaaaaattgtcgtatcattgcagaaaatccctttcaaggccttattgtttgtatatatgtatatgtttctgtgctagggacaggaatggaggcactggcccaaacagcatcatctcgaagcctcctatagggtgcagcactcctgtatacttaggtctcagtaatattcttttagtttccagtggttctgggcattcatgtatgttgtccaagttattactctaggttaaaaagtagacctaaaatgcatccttggtataggagccttatgattagagaagaagaaggtgcaggtggtcattgtcctgaacaatgtcttagtgtttttcattgaacgctgtgaataactggtaaaactccagtgttataaattagcattgaactttgttgagtccttaaaaaagtacctgagagtacacaaaaacactttaaaataagcttaatatttctataattgaatctttaaaaatcattaaagctattacatcatagaaaatgaatttaataacaatgatatctttatacataatgatacgaacatttataaagcatctgttgtgttctgggtactcatttctaggcattgtaaaaatatacgagtagtggtccttgccacgctagaactggggagagtggaatgtaaattaataattgcattaaagtgtcatagaggccaaaatacaagcacatacaaggtgctataatatcatgtaaatggaagcagttatatcaattttggtaagttgggtaatactccataagatggaaactttggagctgtattttgtaggctgagcattggacagatgcagaatcagaggaagagcattccaagcagatagaagagtacagatagatgagaaaaagcccagtgtgttatggggagtagcagttaagttgaagagactggagcagagctttaaggtagaagacttataggtgatgtggttggaatagaaagggagggaaaagccagcttctgaaaccagtttttgatttaccatgttaagcaatttaagtttttccctttagaccagtggtttccaaagtgtctttcaggactttccttactggctgacatagaagtgaggaagtacttacatgctccacacttctgcctcagttagaattttatatgttctccttcacttatgattttgttttgttttattcttaaagaaacttctataggtaaaaggagcccttgctaaggaactgagtaaatgatcagaaaacaattgcctggagggttgatagcaatgaaggtaatgaaatgaaggaatatccgttgctactgtccaaaggagaaatattgagggcctgaaggcaaatccaatagaatggagaaaaggttctgagtgcttcagtaattagagttaatcacacttgataattgattaaatgtagaggctaaggtggtggtctaggatgattcacgtctagcttgggtgataggctggatgatggtataattaactcagacagagaacttgggaagacactcaggctttgagggggaagataatgaattttcaactttaaatatttataaacaaattctgatataagagagtagccctgtgcatataaatgaagatagaaagcataacaacatctgaaatatatcttggtattcaatgaatgaccatctatttcttgcctcctgaaatacattcctagagcctagaaagagtaccatgcaaataatcaaatctgtgtcctggttttgtgggaatgtacagatgaaagaagaaaagaattttaaaattgccttgaagctaaatcatgttgagtaaacattagtaggttatttgttgaggaaaagctctaatatatattaagttctttttatgtactagccgtgggtgccaagtgttttatatatacttcatttaatcttcatagtagccttatggacaatgacttcatttttaaggtaaacaatctatggctccgcgagtttaaattatttgcttaaggtcacaaagcaagtgagtggcagaactgagtttcttttttttttaattttatttagtttaattaatttatttttgtttgtacatattgtttcatcacccgggtattaagcttattacccaatagtaatgttttctgctcctctccctcttcctgccccttctcaagtagaccccagtatctgttgttcctttctttgtgttcataaattcttatcatttatctcccacttataagtgagaacatgcggtatttggttttctattcctgtattagtttgctaaggataatagtcctcagctccatccatgttcctacaaaagacatgatctcttttttatggctgcatagtattccatggtgtatatataccacattttcttttttcaatctgttattgatgggcatttaggttgattctgtgtctttgctatcatgaatagtgctgcaatgaacattcacgtgcatgtttctttatcatagcatgatatattttcctcagggtatatatacccagtaatagaatttcaggctgatagttctgcttttaactctttgaggaactgccatactgcttttgacaatggttgaactaatttacacttccaccaacaatgtataagtgttccttttctctgcaaactcgtcagcatgttttttgactttttagtaatagccattctgattggtgaaagatggtatttcattgtggttttgatttaccacaaatctaatgatcacaaaatctaatgataccacaaaatgtaatgatcagtgatatttagcttttcttcatatgcttgttggctgcgtgtatgtctccttttggaaagtgtctgctcgtgtcctttgcccactttttttttttttttttgagatggagtcttgttctgtcgcccaggctggagtgcagtggtgcaatctcggctcactgcaacctctgcctcctgggctcacgccattctcctgcctcagcctcccgagtagctgggactacaggcacccaccaccacacctggctaaatttttttgtatttttagtagagacgaggtttcaccatgttagccaggatggtctcaatctcctgacctcacgatccacccacctcagcctcccaaagtgctgggattacggttgtgagccaccacgcctgaccctttgcccgctttttaatggggttgtttgtttttctctggtaaatttgttaaagtttcttatagatgctggatactagacctttgtcagatgcatagtttgcaaatattttttttccatcgtgtaggttgtctgtttactctgttgatagtttcttttgctgtgcataagcccttaagtttaattagatcccacttgtcaatttttgcttttgtcgtgattgcttttggtgtctatgtcatgaaatctttgcccattcctatgtctaggatggtattgccttggttgtcttcaagggattttataattttgggttttacatttaagtctttaatccatcttgagttgatttctgtatatggtgtaaggaaggggtccagtttgtcttctgcatatggctagcaaattatcaaagtgccatttattgaataagaaagttttcttcctattccttatttttgtctgctttgttgaagatcaggtggtcatagatgcatagcattatttctgggtgctccaaactgttccattggtctgtgtgcctgtttttgtatgaatacaatgctgttttggtcactgtagccttgtagtatagtttgaagttgggtaacatgatgcctccagctttgttctttttgcttatgattgccttggctatttgggctcttttttggttccagataaattttaaaataggtttttctagttctatgaagaatgccattggtagtctgacaggaatagtattgaatctgtaaattgctttgggcagtatggccattttaatgatattgattattcccatccatgagcatgggatgtttttcaatttgcttacgtcttctctgacttctttgagcagtgttttgtaattctcattgtagagattttcacctccctggttagctctattcctagatgttttattgattttatgacaattgtgaatgggattgcctttctgatttggctctcagtttggctgttattggtgtataggaatgctagtgagttttgtatattggttttgtatcctgcaactgtgctgaagttgtttatcagctggagcagctttggggctgagacaatggagttttctagatacaaaatcatgtcacctgcaaatggagatatatcaacttcctttcttcctagtgggatgccctctgtttctttctcttgcctgattgctctggctaggagctccaataatatgttgaatagaaaagttcagaaagggcatccttatcttgttaccgttttcaagagaaatgctttcagcctttgcccattcagtataatgttggctgtgggtttctcatagatggctcttattattttaaggtatgttcctttaatacctagtttattgagggtttttaacatgaagatgtgttgaattttatcataaaccagttctgcatctattgagataatcatgtggtttttgtctttagttctgtttatgtcattaatcacatctattgatttcaatatgttgaaccaaccttacatcctgaggatgaagcctacttgatcttgatagtttatctttttgatgtgcttctgaattcaatatgcaagtgttttgttctggattttttcatcgatgttcatgaagggcattggcctgaagttttcttttttgttgtgtctcttccaggcttcagtatcaagatgatcatggcctcatagaatgagttagggaggagtccctcctctttaattttttggaatagcttcagtaggaataataccagctcttctttatacatctcgtaaaatttagctatgaatccaacagatcccaggtttgttttggttgggaggctatttattatggattcaatttcagagtgtgttattggtctgttcagagaatcactttcttcctggctcagttttggagggtgtgtatgtccaggaatttatccatctcttgtaggttttttaattttatgtgtgtagaggtcttcatagtagtttctgatggttgtttttatttctgtggtgtcagtaataacattcccttcatcatctctaattgtgtttatttgtatctcctctcttttttccttattagtctagctagtggcctatgtattttattaaatttttcaaaaaaacttcctggatttgtttatcttttgaatttttgttgttgttgttgttgtttctcaattaccttgagttcagctctgattttttttatttcttctcttgtgctagccttgggcttgatttgttcctgcttctctaattgtatcagttgtgaagttaggtcgttaatttgagatctttctaacttttttatgtttacatttagtggtatgaattttcctcttaataccgccttagctttgtcccagagattctggtgtgttgtgtctttgttctctttattttcaaagtactttttgatttctgccttaatttcattatttacccaaaagtcattcaggagcatgttgcttaattcccatgtaattgtatggttttgaatcattttcatcgtcttcacttctgtttttattgtgctgtggtccaagagtgtgttttgtatgattttggttctttaaaaatttgtcgaggattgttttatgtccaattatgtggctgattttaaagtatgtgtcatgtggtggtgagaatgtatattctgttgtttttggctggagagttatgtaaagttctatcagacccagttggtccaaagttgaattaaggtcttgaatatctttgttcattttctgcctcaatgatttgcctaatactttcattggagggctgaagtctcttactattattatgtgggagtctatgtctctttgtaggtctccaagaacttgttttatgaatctgggtgcttctgggttgagtgcatatatatttaggatagtcaggtcttcttgctgaattaaagactttaccattatgtaatgccccttcttaaaaatatttcattggttggaaatctgttttttctgaaattaaggttgcaactcctgctttttttctgttttccatttgcttggtagatttttctccatccctttatttttgagcctatgaatgtcattaattgtgagatgggtctcttgaagacagcatgcctttaggtcttgcctttttatccatcttgccactatgtgccttttaagtggggcatttagcccatttacattcaaggttagtattgatatttgtggattttatcctgtcattgtgctattagcttgctattatgttggcttgttttcgtggttgctttagggtgacactggtctgtgtgtttaagtgtgtttttatattagctggcagtggtcttccctcgctttgcttagtgctcctttcaagatcttttgtaagacaggtctggtggtaaggaattcattcaacatttgctaatctgaacaggatcttatttctccttcacttaggaagctacgtttggctggatatgaaattcttcgttgaagatttttttctttaagaatgttgaatgtaggcttccaattccttctggcttacagggtttcagctaagaggtccactgttagcctgatacggttacttttgtagatgacctgccctttctttctagctgcctttaccattcttactttcattttgaccttggaaaatctgatgattatgtgtcttggggatgatcttgtgtagaatcttgcagcagttctctgtatttcctgaatttgacggttgacctctctagcaagtttggggaagtcttcatggatgacattctgaaatatgtttttcaagttactcatactgtcatactccttggattcaagctttgttttacttcctgccacttggctttaccatcaagtgagccattgagacaaaactcttcaatttttagtcctttgcttgtgcctagaatgggattatagagctagacaaaacgttgagtgaggaaagacatgagcacatttgttaaagatgcagacagttaaaaaagtaatcaagggaaggtggaggaatctgcagagctctacataaattccttccttagtttacatgaatttattttatatgcccagcagtatcttattcacctgcattcaaatgtgtggaggaaaagttaaattgttggtcttttttcctcagcaggtgcatgcaaaaaatgccagtgaaaaggattagaaaaggttcaggcatcattcttagatttatttcagaatagtcctttaatttatatagcttgacatgtaaatcatccaggatgcagtataatgttaggtgtgccatattgctttatttgcatactataaagataaagtcttctatttttatctgattttattttcttctgtaatttgtatttttgttttaatttaaaagaaatttattttactcttggttatatttttcctacataaggaaacctgatttatttaaactccactagttcagaatttgtgagagttcagacagtgtatatgccaaagtctctggtattagtaagaatatcttatttagcaaattaaatgtatgaacaataagtgtgtgtgtatgtgaatatgtgcacaaatgtagtgtcgttaaaatattttggggttatttaggtacctgaaatcactttagtgagatctgttatacaagtaatcaacatattaattaatactaatgcatctttattcactaaggtaagtcccttaggatctattcttgataatattgtcagatattcatttagatattatatctatgtaactatcgacatatatactattgaaatagatttagagctatatatgcattcattctttcatttaacatttatttattgaacatctgctctgtaccaagcaatataagaatacattataacactaaaatagcattcattttgtgagttagagttttcccagattccacctagcctttctctagatgttccaaaatgaagttagactgcttgttgcctttatatatttgaactactgatattcccatcttatgtatttctgtctttgtttccatcatacaatcaatagcttaattccccaatagctcattctgatataagtatcccattttctagtattttctgtaaaacatttagggatacacagggagaaaaggagagggaatattatatacatccttctctgtatctctgcagaagtgctaatatctctggatcacactgatgggatggatttgttgtttgtgcctttgagtttcccaaaagatgatggcttccctttcctcagcttatgaagcatttctaatagacagatgtgaaatttggcctgagaaagatttaaacggacagcttacaaggaagaaataaagtgcttcagatgaaaattctgtggtgttcattccttaaaaggttcttaagctggtttgtttattctagctatatcatggcaaaattgttttttaagaatgtcagatgccattcatgtcttcaggtaactaagcccatgaagattcaattcagcaatagtacctacagcactcaactcgggattagcaaaaccaaaagtagaattacatctagtgttgacagtgtgaattcaatctcataatataaggccaattaacttcattgcatcattggtatcagtatccctcttttcatgatgcatttcaaattttcactcacttagattggatgctaagaagtggtcataaagagatgtcctaggacattctcagtttaaaaaaaatatcaagccctcattctagaaaacaaactaaccattctgatagtttccttaaatcaaataaatttttccttttttagcagtaaaaaatagtttaattgacataaagacaatcacacaggagatgaagttattactcaaatcaatctctaaaggcttgtaggttagggtttttttggacaattctgtgggcaggggactgaaaaatgggtgctgctgattggttgaggaatgaaatcataggggtgtggaaaacagttttcatgtgctgatcctgtctcttgatgggatcgcaggataagtcgaatcctaagtcatgaatctgggtggggtcaggctgaaaaaaatctccaaaaaccaaccttatatctactatagtgatgttatctacaggagcaattggggaagtcacaaatcttaagacttcaggccacatgtctcctgagcagtattgggttagaataatacacctatattttatcagaactcaggcccctcccgtaatcccaatcttgtttctttacattaattttacctaggcagttttatccccagaacagggagtggactagtttgaaggaggaactattatcatccttgtttcaaagttaaactttaaactaaattcctccaaaatttaccttggcctatgcccaggaatgaccaaggacagcttggaggttagaagcaaaatggagtcaactatgtcagatttcttttactgtcataattttgcaaaggcagtttcaatctccctctttcagtttcagcacacctctatcctgagttgtgagctaaggagatgggaaaaagctgatgactgctgtaactacttcctgctgacagggggtggagttggagtcaggattgctccttggatgagaggagtgaaagcagtgaagctgttttacagtgtctaaaaacataccttttcctaggactacctttgggtttttaaatgagcaatattggaaagtatgcttcatatcatataaacagcatatggtgttttttatgtcattgcattttctttaattcttgggtgctcacaaagaaacattggcataataggagccagagtttgaattactaatatttctaacgtagagtttagactaacatgcatttgcagattctctactaaagaaaaagcttaaacacatcagcttaataattagaactacatttattatattagctgaatctcagtttcccaaacacaaatttttgttttaagatgtctgtcagtgctccttattctatatgtagtatatttattttaacttaaaaatgtctccccccaattttttaggctcctgccaataatatttgtcctgcatggctgggtcataaggcagaagatattgcttatttctggaggtggaggggagaaatttaagcaaacctataggatgttggtgatggtgatggtgatgatgatagtaatgatgatgatgacatatgataataatctatatagtgctttaccaaacatcctcacatctttaatgtctgtatatgtatatgcatgtagctctatgttataaagaactattttcaattgtttctcatttgatcctctcagcaatctggtgaggtaagcatttttagcgtttctgattaggaaatgaagaaaatgagtttttaagaagctcagtgacttactctaaatctcagagacaataaagatttgagccagaatttataaggccaggctttttatttatcataaacaacatactttcccaaatatgctgaactatctctgaaaaaaacaaacaaaaaaaccctgggtattaaaaattgaggttatgaatcttcaggctcgtattggaaccgcttaagttaaatgtaggagatcagatgtttggtgtttcagaaataggaaatccttggaataatccatctatttatctgtcgttgatcatataacttcaataaaataaaacactttaattttcttttttgctccttcttatagtagtttacatgtggggcagctagtataaaaatggttgatgattattgttattatttgttgtggctataatttttccttctaagaagtatgcaaaatcttctgaatgactgcaacctactttttgtatagagaaaggtaacagttataaattgttccttgtgacaattcctgagtgaattactttgatatatatggctaatgaattaatatgattaagttaatgagaaatgcaagtgttgccaaactccactactctggcagtaatgttgctccacatttgcagttttagcttccccctgtgttgagaggatcactgatgcctacacactgtcgttgtgataaatgatgtatcccacagtgccctgctttccatctggtccatcctcaaaccatccccaaatgagagatctcttacaaaaattacatagtcacaagccaagtctattggattataaaaagacatttccatccctagggcccatccttcaaccacattttccccataattcacaaattacatgaaataaaatacacaagttttcacctactacttgtgttactctttcattgtctgctctttattctggcgagcttttgttttccagggcagaaagggaacatttacatagcacaataaagctttccattgtataatatgcctgacaaatgataagctgccttgttactactttattttattggatggagtggatggctgtactaaaataacccattatactaaagcatgtagtttgtcaaaatatattctgtatccttcttaaaaaaaaatacattttatcaatcatccaagggattctgcagagcaaaatagagtgtctatcatttcctattgaagaattaaagagtaataaaatttgtcatatacaagtatcacctacatattgtgaccaaaaatgagtaacaaaatgtatccttggcacctagaactcaccttttaaaaattgatagacaataaggtattctgccattttaatcaaccaaaggttggagaacaggaattgagtactttgattgtagtggtgaaaatgttttcttgtgacttgtttgctccctttctggcaatgtctaaaatctagatcatgttttgaactaattttcagtttatgttcaatgtaggaaaaattctgagagctctcaaaatggtagttcttagtaacacattcatacacatacctgagtcaaggtagagaatgcccaaacgtagagcttaaaaatgttattaatacctgtctttgttttcccagagggctcttatttaactcttttaatgtatacctgaaagtgtcaggtgagaatgctttttgaaacactgtgttagatcaaactgggttagcaaatcgtgctttctacatgattagtagaaatgaaaattagaattcccagactaaattacaacataaaaaggggcagttatactctgacttaatttatttttttttctgaattctcagcagtaatgacatttcctttctcagtagtgttacttgcataatcaagggaccaacagagaagaactatagtaatatagaaaaccctttctcccttaaaccttatttgacaatatatgaagtcacacaaacacctgtaaaaagagtaactgaagtgggtcatagtagatagcaatgaatattaaattgaggtgagggtaagaaaggagggcgattttctcatatagcaccaatattgggtgaaaatttaataatcagttgatagatgtctgcctatctatagttatttgagaagactaaggtccttgttaacaactacattctttaaaaaaggttttactgaggtataattgacatgaaataaattgtacatagaaagtacaatttgagaattttggactgttgctcacctatgaaaccatcaccacagtcaagatagtgagcatactcattttctcaacctttctattactacaccctttcttccctgtctgtctcccaggtaaccactgatctgtattctgtcaatatatattagtttgtattttctagcattttatataaagagattatgtagagaatgcactattttttgtctgacttctttcctttagcataattttattgagattccaaattgttgtgtataacaatagttcattcatttttattgcttagcagcaagtattttatggtatgaatataacataatttgtttatatatttcactctttcagacattggagttcttttaccagtttttagctattgtgattgacactgctttaaggctttatgtatacattttgtgtggaaatgttttcatttaccttgattaaaactagaaatggaattgctgggttgtatggtgagtgtatgtctatgtttataggaaactttaaaactgtcttcccaagtcgtgtcattttgcattcctgtcagctatgtatggttgttcatatcattgccaacacttactgtgtccagtcttagaaatatattttcaacaatatatcccacctgaattcaaacattttgccaacatactgtctcctgtctagaagcggatttttgcattaaagtaagtcatactttgtttgatcatgactcagtataaattagtatctatttctgcttaaatacaggtttatagtctaggagtaatggaaactgaggaacagagtgaagggcatattatctggggatgatcagtggtttggctctctacagcgtcatggaccttgatgttgtgaaaaggaactaaaagagcaagagagaggagcatagagaaagtggaaaggtgacccaaacaaattcttcctacttctcagttttgcttagggtcagtctagtatataaaacaaatatttgcaaactaaaagttggaatcatactatttatgactttgttatagtcacacagttggctttttgatctggatcacatttaaagctgaaaaagatatcctttggaaggaaaaagcaacttcctgcaaggctaaaggagaaaaattattttccttgtatttgtggcaagggcattgtgaaaaaaaagcatactttttggacttagggtactctggccacaagagataaaagacccatgtttagtttcaaaggaaaaactcttaagatattacacctcattgtaaacgtgtgaattgaattctaagcttaattaaagtaattaggtaaatggataaataaatgggaagagatattacccttaaactgtctgaaatgtatggcattttgtcacagtattaaagtgaaattgaagtttgaggtcaaacagtgtctggtatgcattttaatgaaaaatatatgatttagagaagtaaatctttttattttcacagtgtaaccactatgcttcatactttttaaaaattgggacccaggctaatatttggtttctgtagataattttttgaatttttaaaatatattatacttgtacatatttatgaagtacatgtgaaatgctattacatgtgtagaatgtgtaatgaccaagtcagggtattcaagatatccatcacctgagtatttatcatttctatgtgttgggtacatttcagatcctgtcttgtagctattttgaaaaatgcaatacattggtgttaactgtagtcacatagtcaccctattctgctattgaacattagagcttattccttctttctttgtttttagagaaaatgtcttgctctgtcacataggctgcagtgcagtggcatgatcatagctcactgcaacctcaaatgtctgggctcaagtgatcttctcactttgcctctgcagtagctaggactataggcacacaccactatacttggataaatttttaaattttttgtaaagactgggtctcagtgtgctgttcacactggccttgaactcctggcctaaagtgatcctcctgcctcagcctcccaaagtgctgggattataggtgtgagccactgcacctggccttagaacttattctttctatcaaactgtatgattctacctgttaaccaacctctcttcaccccctcctgtattcataccccattcccagtctttggtatttatcattacactctacccccatgtgatcaacatttttttttttttttgagatggagtctcgctcgtcgcccaggctggattgcagtggcacaatcttggcttactgcaagctctgccttccaggttcacgccattctcctgcctcagcctcctgagtagctgggactacaggcacccgcctccacacccagctaattttttgtatttttagtagagacagggtttcaccgtgttagccaggatggtctcaatctcctgacctcgtgatccacctgccccggcctcccaaagtgctgggattacaggtgtgagccaccactcccagctgtgatcaacttttttagctccctcatatgagtgagaacatgtgatgtttgcctttctgtgcataaataagctatggcttatatcccttaacgtaatgacctccatttccatccatgttgctgcaaatgacattacttcatttttctgtatggtcaaatagtattccattgtacatacacacacacacacacacacacacacacacgcacacacacacacacacacacacacacaatcacattttctttatccattcatctattgagattttttaggaccagaatatctattgacttttttgtgaaagataactaaagtgaacaagggcatagagaagcttgcatataaagcatattagcccattcaaggcatgcactgagtgattaaagtgattaaaatttatttactaatttaaaaaaacatgaaataatatctcaaagatcatagaaggaaataggagtaatacttgaaaattttataggctgaaagggagagggaaatatagattttctggtttaaaagtttgtcccaatcatagtttatatggtttggctctgtgtcctcatgcaaatctcatctcaaactgtaatcttcatgtgtcggaggaggaacctggtaggagatgattggatcatggaatagatttctccttcgatgttctcatgatagagtgagttttcatgagatctgatggttttaaagcatggtacttcctttctctctctctttctctctctttctctcctgccatgtaagatgtgccttgcttctcctttgccttctgccatgatggtaagtttcctgaagtctctccatccatgtggaactgtgagtcaattaaacctcttttctttataaattactcagtcttaggaagttctttatagcagtgtgaaaatggactaatacagaaaactggtactgaatgaagtggaggtttgctataaagatacctgaaaatgtggaaacaactttggaactggataaggggaagaggctggaagaatttggagggctcagaagaagacaggaagatgaggtaaaatctggggcttcctagagacttgttgaatggttgtgaccaaattgctgatagtgataaggacaatgaagtccaggctgaggtggtctcagatggagatgagaaacttcttgggaactggagtaaaggtcactcttgctatgctttagctaagagactgaaagcattgtgcccctgtcctagaaagttgtggacctttgaacttaaaagagattatttagggtatctggtgtaagaaatttctaagcagcaaagcattcaagatgtgacatgactttttctaaaagtgtatgctcatatgcatgaagaaagagatggtctgaaattggaatttgtgattaaaagcgaagtagagcataaaaatttgtaaaatttgcagcctgaccatgaggtagaaaagaaacacccattttctgtggagaaattcaaatcggctacagaaatttgcatgagtaacaaggagcccaatgttaatagccaagacaatggagaaaatatctccagggcatttcagagatctttgccccagcccctcccatcacagacctggaggcataggagggaaaaatggttctgtggggtgggcctaaggtcctgctgctgctctgtgcagcctcaggatttggtgccctgtgtccatgccactccagttccagccatggctaaaaggaaccaaggcactgcttgggctgttccttcagagagtgcaagccccaagcattggcagcttccacatggtgttgggtctacagatgtgcagaaggcaagagttaaggtttcagaacttctgcctagatttcagaggatgtatggaaatgcctggatgtccaggcagaagtctgctacagggcagagccctcatgaagaatctctactagggcaatgcagagggaaaatgtggaattgggacccccacacagcatccccactgggacactgcctagtggagctgagagaagagggccaccatcctccagaacctggaataggagctccaccaacagcttgcaccatgaacctggaaaagccgcaggcactcaatgccagcccttgaaagcaactgctcaggctgtaccctgctgagccactggtagagctgcccaagttcttgggagtccaccccttgcatcagcataccctggatgtgagacatggagtcaaaggagaatattttagagctttaggatttaatgactgctcagctgggttttggacttgcatggggcctgtggcccctttgtttcaggcaatttctccaatttggagtgggaacattcaagccatgcctgttcccccattgtatcttggaagtaactatattgttttgattttacaggcttataggtgaaagggacttgccttgtctgagatgagactttggacttggactttagagttaatgctggaatgagttaagattttggggtactgttgggaaggcatgattggttttcagtgtgaaaagggcatgagatttgagaagggccaggggtataatgatgtagtttgtctctgtgtctccagcaaagtgtcatcttgaattgcaatccctatgtgtcagagaaggggcctggtgggagatgattggatcatgggtacacattttgtccttgctgttcttgtggtagcatgtgagttttcacaggagctgatggttttgaagtatagctctctctctctctctctctctctttctctctattttgctaccatgtaatatgtgccttgcttctccttcatcttctgccatgattgtgtttcctgaggcctcctcagccatacagagctgtgattcaattaaaccccttttctttaaaattacccagtctcaagtagttctttatagcagtatgaaaatgaactaatagtctagttcaagttctgttagagatacttattgagataataaatttatagagagtgatttatataaccttaggtttattcataataagctcattcctttctgaaggtgacatctgttgaagtttatgatctcaatttcccaaatatccttcttgagtatcctatttgagatagaaccatacattgttcatttctaaaacaatgttttagaaatgcataacattgtttaaaagaaataagtaaaataaagttctctgtttctgtttctttggaatttataacaaaaaccataatttgcttaccttttagttttgttcatttgactagcaatggacaattttttaataacttacattgttttatttatttatttattttttaatttttaaacacagagtctcactctgttgcccaggctgcagggcagtggcatagtcatagctcactgcagccttgaactcctagactcaagtgactctcctgcctcagcctccaaattagctagcactatgggaatgtgacatcatgcatggctaaattttttgtgttggtttttagaggtttagtctcactgtgttgccaaggctggtctctgactccccaaattattttacatttatttttattaattatctgtcccttgcttgaaactcttctatgccctttcattgaaagtaaagttaaaattccttcacatagaaaaagtgtttttctgatcttctttattgtaactttctatcatcatctctgataacttctttaaatacagtgtactctgtaacctaaataaacttctctctgttcttcatatatctcttactctttcacacttccatggctttttgcatgctcttcactctgttttgtatgatttatgaaggtaagcaaaagcttattatcaaatcgtattattttttgacataagtacttctgagttagtatagcagagcattaattacatacaatcatttttattctctttaaagtaaaagtaaaatattgaatagtgagaccattttccccaatttattaggagtaccaagttctttctacaaaataagttgaccaatgattatcaaccaccagctccattttctactcttacaaattctttggtgccattacttctatgccattttttttttaattccagaatggtaggatcaaggaggccagataaagccagtgatatctcatgtgatatttgtggcttgtcaaatgtatgcaaaaacaagaatttctatgaagacatctcctttaatttgtgtatctgaaaaagggcactgctaaccttcttagactcctaagagtttctgcacatactctgctactcagaaaattggactgataacttaaggctgctaaaagtgctctggaatatttattaatttactagcaaattccctatagcctgattgcttcctatttgaatttgttaatttgaaaccttggtcacttgtctttgcagtattccatgacgaagttagggagagcagctataaggcaaatcaaaacaaaagatggtgggaggtaaagtgccccaagttgaagctttatcatagtatggcaacagttttgtggagttataggaagggaaggaagaagttaattggccatttgtatttgtctagacagaatgaaagtaggttgtatgaactatttctgttcacagaatagaaagctgaaaaattatttttgaattgtatcatgtatgttggatgacaagatgacacacaaatagggaataaattagcaaattatttgaaagtcattatatattttcttcccttaatatctgcaatatcacttaaataaaaataaaaacctcagtgaacagaaaactcaagagtttgaaatttagctctgctggtcagaccgtatttggcttgagctaaatcatgcattagactccacttggctttctttctagactcagaaatacccttctccctttctattgctgaatgacctagtattctctttcatttagccctataactttactaaagtgctttctcttttttaattgtttattttcctttatggatttcatggttgtatgcttttggttttattattgtatgtctttttactttaggattgtatactctctcagttttctcctatgtcccatttgctgttcacttcaatttatgccttttaagtggactttcaaggaatttaataatcacatgatagattaaattaaatttatattttttcaaaatagtctttaaattttaatttatcttatcaaatttgcattgatcatcaactaaatttgaaacaaagttatctagttatctgctcacaatgaacaaatttataatttttatatcatgcacattattttagaataagcaaggagataggacagccaatatattgatgtttcttgattaaaagttatgaatagctctatttgaaaagcattgtttaattttatgtttttttaggcagatggggtagaagtcataatttcatttttgcaatgtctccttcattcaactcatccatttagtatttactcaccgtctgttacatgcctgaaaatgagaattcaaaattgtatatgatatgatccttgccttcaaagaactggtcctccagattgagagaatgtcttagtatgttttgtgctgctgtaacagaatatgtgagaccgggtaatatataattataaaccaaaagtaatattctaagccccccagccaattgaatagactcctctcttggccatgggtatcccaaggaaatctgaaaaactatttcaggccatgatgggaagcaggggtcaggatgtgcctcattatactttcttccctttgcagtttagacacattgaacccacattaacattaaaacagagatcttaagactgacaaaacacactgtagcaataagataccaactccaacctgactctggtatagcatcacattgtaacaccaaaggttcttgccttagccacgccaaagtattggtgtggtggcagcctgtggcaagagagagacacggatctgacagagagaaaaaaaaacggtaggctttattgagcagagtgacagtacaaagcttccacagcctggaaggggtcccgagcaggtagccagtgttagatttttcgatcaccttttcaactctttaaggcgggaaatacgtgcagtgggaagatgttaccagagcgagaaacagagacaattaacatgtctcagatcttgaggaaaaccggaattgcaacttaagttttatctaccttatgaccttgcagcggcacggcaaaggagacaggatctcacaggattttataaattgtgttacaaggaactggaattgggagcatagataaggtctgctggtcacagaaaaatgggcttttaaccttccttttagtttcaggggaaggggaagggagagagggagagaagacacagggaagcttacagcaaaatttttgctgtttatagctttctttgggaagaaaacacatgcacaaattctgatgttaggaatattttaagcatatatcttcaatattattcatccaggaccaaagtaagtcctgatggaggaaatgagtgagtttcacagctttctgagcccctactcgacccaggaagcccagctggcacctcctctcaacatgatgtaacatttcctgaaggaaatcaaagtattttatctcaaaatatatttctttggcatattttgaaatggccctgcaaagctgtctcttatgggggaaatttgctctctgtagagaatctccttccattactatgtcttttcaagagagtctgacaagaggacatccaccatctattttctctggagcctgatatctggagccttcatctacatgataaaaaccttggcttctacaaccccctttatcttgaatcaagctgagttcaactcttcaggtggtgctcaactctttcaatgaattgtcaatcaggaaatctttgaatccaccaatgacctggaattcccccacttcaagatgtcccacctttcagagccaaaccaatgtataccttatatgtattaatttatgtctttcctgtaacatctgtctcctcaaaatgtataaaacgatgctgtaacccaaccaccttgggtgcatgttctcaggaccacctgaggctgtgacagaggccattgtccttaatcttggcaaaagaaacctctaaacaaatttagacttgtctcagataccttttggtttatataatgaacagaaatatattggctcacagttctagggtcttgtggatggcctcactcccacagttctgctgggcattgttttagtggaagctctctgtggtggctccaccaccatgacaagtctttgcctgagttcccaagatattggagacatcctttgaaatctgggtggagaaagctatgccccacattccttgcattctgtgtaattgcagaattggcaccatatgtaggctgccaatgtttctagcttgtactatccagtgtgtcaaatcaagccacccttggacccacatgagctatggctgcgtggcttaagagtgttgcattagaatgtgtttagcaaagacttgaggtgaccctaagcagggattcccaaagtcccaagcatgccccaggactcttttgacatatttccttcctccaggtcttcttcctctggcctgtgatgggaagggcagcaccagtaatttctaaagtgcgtttggggtcattctcccattgtactgatgaataacctctggctttgttctatttatactaatatttgcaaacattttctgggccacacccttgttttcctcccctgaaaatgctttcattctctaacacagggccagactaaaaatccttctaatcaataaattctgtttccttttaattataaattccatctttaaatccttttttccttctcaaattttactataatcagttaaaagaagccacacagcaacctgaattctttgctttttagttattttttttcaccagatattctagttcattgctcttaaatttaccttccacaaagccctttggcatggatacaatttggccacattctttgccacttacaacaatgttggtctgtcaggcctctgagcccaagcctgcaggtatacatccagatggcctgaaacaactgaagaatcacaaaagaagtgaaaatggccggttcctgccttaactgatgacattaccttgtgaaattccttctcctggctcagaagctcccctactgagcaccttgtgaaccccgcccctgcccaccagagaacaaccccctttgattgtaattttccactacctacccaaatcctataaaatggccctacccctatctccctttgctgactctctttttggactcagcccacctgcacccaggtgattaaaaagctttattgctcacacaaagcctgtttggtggtctcttcacacggatgcacgtgacatggtctttactctattttctaatatattgttcctcatttccttctgagacctcatcagaatgttctttactatccatacttctctcagcatcctgataatcaccacttaaataatctctaaaagattcagaattttctacaattcttttcttttgagccctcaccaaaattttccttagcactctatttatggcaatctaggctttttcttcccttcacctccaaattattccagcctctactaattacccagttccaaatcttcttttacattttcaggtacttgttattaacaatagccccacttctcagcaataattttctatcttagttcgtttttacttgtatatcagaatatcacagacttggtaatttatgatgagcagaaatttattagctcacagttctggaagcttggaagtccaagatcaaggggatggcaactgtgaaggccttcttgcagagtcagcaggtggcaaaaggcaagatagcaagagaggacaagagagcaaacttttagcctcaagttctttttataatcagtatttttcaattcatgtgggtggagctttcatgacccaaacacctccccttaggcctcacttctgaacactgttgctttggggattacatgttgatcacatgctttttgggagacatattcaaactgttgcagagagtgtcccaataagtaaagagttatgagataattttatttaagtatctctgtatgtgaaggagaggactccatgagaaagtttgaaagcttcaaaccaaagaaataatcatgagttagaaatagctataggtgtagggagccaaatgtgtttaccatagaaagatgtggcacacatctctgagagtataatgagtgcaaaatggagaggctgatgagatactaatattgtttggctctgtgtccccacccaaatctcatctcgaattgtaatccttacgttttcagggagggacccggctggagatgattagatcatgggagtggtttcccccttgctcttcttgtaatagtgaatgagttctcatgggatctgatggttttaaagtgcttggcggtttccccttcactccctctctcctgccaccttgtgaatacgtgccttggttccccttcactttctgccatgattgtaagtttcctgaggtctcctcatccatgtggaattgtgagtcaattaaacctcttttctttttaaattatccaatctcatgtagtatctttatagcagtgtaaaaatagactaatacagacaccttccagaagaaatttgtaggtcttaattgcagatgtgttttattatgaggacaggtccaaaaagaacatcatagggtattaccttcccattttcatttcatattaatttaagctgtttattttgttgttgctcatgatactttctctttgaagtgtgcataggacttttgagatcttaaaaatttggtgataaaaaactgctctattgagaaatgagtgaacacatttaaatatggggcacaaaatgaatgctatacaacaagctatatggctctgagcacattactttctcctttctgtgactgaattttttcatctgtataatgaagataataagtgtcagcctcatacatttgttataaaacttaaatgagattatgaatgtaaacaacttagcatagtgtctggcatagtaagtattcaataatggtccactattactattattattaggaaaatctgacttaaaattatgtagtcatggcatgaagattctatattacaattgatccattcgaaagggggtctctctacaacttgacttaggaggtttaaaaatcagtgtgaataattaattaaaagtgtgaatgattgcaaaattatggttacaaagcagcttatttttctcaaactaaaaaattcaaaataatgttatgtttagctatgataaactcaatacatctttaagcatctatgtttgaatgtaatattatttgatttttctatgagcattatagagaatgcgttggattcatcattcttctgctactgagtggtttctgtctgctgattttcagatagcacttaataactcccaattaacctttttatgtatttgaggaaaatcaggagcaggcagccatgtggatattctttagtctgcagtgggaatactatgtgaaatgaaataccaggaatatcacaaacacagaaacaagatgttaaatgtgaatctgaagacaggcactacaaccatcatgccaaaaaaaatatgcatcacatctcacattcagatccatcttttcaaccacatttgtgtacaaaggaaagtagcccaatcagcagatatattgtcaaatatgaagaaagacaacatatgttttgatctcttctgttggtacattcactagagttatattgtctggtgaatatccaaattgtgactattgatcgggacatttagttgctgaacttacagctgttcttcagttggagcacaggaagagttatttatttatttgtttgtttttttgtagagtgcagctggtacactagtgtcaaaattacaaacttcaaattagataaatatttgctttatgttgtaatttttagtgctatgattgccataatttgttgctactcagacaggctgtgaaaaagatgtgagtcttcactacataaaaaatataataaattaacataaactaccatgttagagaagtaatagcccatatgtttatgaatgctaatggtatacttggttggcattcagaaatgttgtaattaaacaaagtttccatctaataatgaatatcatctctcactttatagttcttatgagctgagggacagaaatattcattaccaaatgcttacctgtgaaaaacctacctgttacaaaaatgtgggttctaatataatgattatggtgttatgttaaacatataaatcagaaacacattcgtgtgcaaagcagatttcctttcttgctttgaaatcaatgttacactgaagacatatcaggttctcatttctattctattgaatttgtaagatacaggagaatatagtattgttactcaatggtttcagaatatatgctccttagcacacagttttggcctctgtgataaatgcttctttacatctccagaaaataataattgctttcaccttaattccaatttataggctcattgtggtccatgtctgtattttattttctctcaccccttccccccttgtctagcacggtatatttcctttaatagacactgaatatgcttttgttaacctggaatatatacatatttatacaaatataagttattatagagggcagactcaaaaaaaggtaaaacttgattcctattaaatcatttttctttatgaaaagataacccaggtctcattgggttaacaccttagtttgataaatggaagaaaaacatatctgattttagtgtaagaattatataaaaaattagggcaaacaagtcaataatatttaattcatttgagattatatttaggaggaaaaaagtagataacatttactaaacacactatatgctcaatagtatacattatcttatttgatcttaacaacaactatatgagataggtactcttattactctgattttgtaaatgaagaaatcatgtcacaggggtgtttgtgtgtgtgcatgaggaggaaggtatctgccataaatgtttttcacgagatttcatccaaggagttctaactccagagcttgtactcttaacccctgagtggttaaaaaagagaaattttttgaggattactagacaattgatatctgaataattgtgaagtattacacttagaacaacatccctatctccatcaaataccttccccattgtttcattttaaactatttttttttcttacagaggcagtgatgtaaagatgtaggatattctgtcactttctcttcccttttatggtctgctttttatccatttctctgcgtgtttgcttctccaccagacagttagggatagaaaaagaaagtgaaattccctggaacatgaataaagtgctattgttggaatatggtttgtccccaccataactcatgttaaaattttatccccagtgtgttggtgtcgggaggtggggattactgggaggtgtttgggccatgagtgtgatctctcaagaatggattggtgcccttcccatggtaatgaatgaaataattctaggtcttatgaagccaaattagttcttgtgggaatagaataatttttgcaacaatggttgttataatgtcagggcaacctttggggtgcccttttcgcatgagtctgttacacctttgatctcctgccatgttgaaatgcagcacaaaaaccctctttagaatcagagtagatgcctgtgccatgccccttgaacatcctggcccgcagaaccataagctaaataaacctgttttctttataaattatcccaactcaaatgttctgttatagcaacacaaaaagattaagacacaaggtatcagatttatcttgacattaaaatcacccttccactcaataacacagataatatagaattcacattccctggagaagctgtctgtgcatatgggcctagtgatcactgaggtggagcagaaacctagcttctcagacatcacaagattcataatgcaatgcaagactgtgggcatctcctacactagcatctgtggctatcaaggacttggccagaaacacaatactccaaagctcaatgaaaatcatcatactttttggtactgagtccatctgatgttcacccgacctagtctggagggccaaggggggccttctctaaggaaaggacatttgaacagagatctgaaagcctagaagaaggttgactaaatgaagccagtagaaacatctgtcatggagagacagaggcattaagactggtgcgctcagagtagatcttcagacagaaggcattgagagtggaaagaatgaggacacagaggcagggctgaagagagaggaagatgggaactcagcatgggactactgcacatatggacttgttcctgccccccactgactcctagggaaggaaatgatactagtcgactgaatccaccttataaacctccaagggcatcaaagaagataaatgcaaaaatataaaagcaatccaaaggatagcaacttcaaagattggaggatcattacccctacagatgaaaaagaaacagcacaagaactgtcacaagtcaaaaagacagaatgtcttctcacctccaaacgactgcactagttccacagcaatggttctaaaccatgctgacatggctaaaatgctaaaaatagaattcaggatatggataggaatgaagatcattgagatataggagaaaattgaaacccaatacaaggattctaaggaacacaataaaatgatacaggagatgaaagatgaaatggccattcaaagaaccaaaccaatttgacagagctgaaaaattcttcaagaatgtcagaatacagttgcaatagtttactgagaatgatgatttccaatttcatccaactatcgcaagaaccaaaaaccaaacaccacatattctcactcataggtgggaattgaacaatgagaacacatggacacaggaaggggaacatcacactctggggactattgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaaagaatacagttgcaagttttagcagaatggaccaagctgaggaaatactctcagagctcaaagaatgattctctgaaataacctattcagacaataataaagaaaaaagattaaagaagaatgaacaaaatctccaagaaatatgagatgatgtaaagagaccaaatgtatgactcattggcatcccaagacagggagagaaagcaactgggaagcataattcaggatattgtgtatgaaaatttccccaatctcactacagagaccaacattcaaattcaggaaattgagagaacccctgcaaaatactgtaccagacaacaatccctaagacatatagtcatcagattatccaaagtaaacatgaaagaaaacatgttaaaatcagctagaaagaaggggcttgttacctacaaagggaaccccatcaggctaacagcatgcctttcagcagaaaccttacaagccaaaagagattaagggcctatattcagcattcttaaagaaaagaaattccaactaagaattttatttctggccaaactaagcttcataagtgaaggagaaataagattcttgtctgacaagcaaaagttaggggaatttgttaccaccagacaggccttacaagaggtcctgaagtgagtgctaaacatggaaaggaaaaacccttaccagccactactaaaacacactaagtacaaagactattgacactatgcagcaacaacacaaacaggtctgcataatacccagctaacaacactatgatgggatcaaatccgcgcatgccaatattaaccttgaatgtaaataggctaaatgccccaactcaaagtcatacaagcgacaattagataaaaaagcaagacctaatgatttgatatctccaccccctgggttcaagcaattctcttgcctcaacttcccgaatagctgggattgctgatgtgtgcccagataatttttgtatttttagtagagagggggttttgccatgttggccaggctggtctcgaattcctgacctccggtgatccacccacctgggactcccaaactgctgggattacaggcatgagccaccatgcatcgccttgcatgagtattttcattgcagcagtattcacagtagcaaagacatagaatcaaccgaaaagcccaccaacaggagatttgattaagaaaatgtagtacatatacatcatggaatactacacatccataaaataaaagagatcttgtcctttgtagtaacatggatggagttggtgaccattaccttaagcaaactaacacaggaacagaaaaccaaacaccacatgttctaacttacaatttggagctgaacattgagtatatatggacacaaagaagggagcaacagacaccagggcctacttgagggtggagggtgaagataaaaaaaactacctattagatactatgcttattacctgggtgatgaaataatctgtatacaaacccttgtgatgtgcagtttacctagataacaaacatgcatatgtacccctgaactgaaagtaagagttaaaaaattaaaattaattaaaatcatttaatgtaatgtctccagtcttaaaaacataactaaggacaaggattttaaagtggtttagagtccacagtcattttcataaaggtcaaatgtttcttcccactcagtttattctggtaagtagtttcataatgttactatttttcaatgtttataatttaaatgagaaatgaaacatttttagggaaaagaaactttattaagggttgattatattacataatatttttatacctgagaaatacaggctgttttaaaagcaaaccatgaaaggaagataataacttcaagaaatggaagagatgataatcataagtcttggcatattgaaagaacatttctaaactttgttattaaattaggcaagatcacattttcatttattactatagatggtttacaaggctgttgacctaattattcctatgaaaaatatgggtgaattgtatcacagaatatgaaataaaacattggctgaagggctgaagtaatggcaatttagatggaatttaataatatattttattttccagttttttgcagcaggtttttttccttgaatggtcaattaatgtgggaataattcatgcgcagatggattggctgtgctcttgaaataaactgttttcaaaattccaccaaaattccaccagcagatggatttaacctaagggagtagatgttcaatgtttggctccatgagctgatcttgtatttgagaactccccaatacctcctacctctttcttcttcttcttcttcctcttcttcttcttcttcctcttcttcttcttcttcttcttcttcttcttcttcttcttcttcttccttcttcttcttctttcttcttcttcttcctcttcttcttcttcctcttcctcttctacctcttattcttcctcttcttcctcttcttcttcttctttctttttttttttttttttttaagacagagtcttgttctgtctcccactgtcacccaggccgtagtgcaatggtgcaatctcggctcactgcaacctctgcgtcccgggtccaagcgattctcctgcctcagcctcccgagtagctgggattacaggcgcgtgccaccaacctgtctaatttttttgtatttttagtagagaaggggtttcaccatgttggccaggatggtctcaatctcctgaacttgtgatctgccagcctcggcctcccaaagtgctggaattacaggcttcagccactgcgcccagccaacacctccctttcaaactggatcatggggcagatgcctcgtattttcaaactactgtttgaaaatatctacttacctacttttttgcaggttataagccttctgaactgcgcccattttcacttgtttttaatgattagcactacaagacttgaccctgtcctcccttgccctggttgtgtcatcttcaccttctaatcccctttatctggacccactataccagtaaagtgtagataaattcaggccatgcacctgtgaattagatacccctgtttttagtataagagtgagaacaacatgaaaccctccagtgccccaatccagttgttttgtccgaagcccctttgacatgtcagagagaatcccgattatgtaaagaaataggtcaacctgtggaaacacaacagatgggttcagtaaaactttattgaatacctccaatgtgcatggcaattaaatgaaacccggggagtttccttagataaaattaaaaaatttcattggccagtgggactattatgtatctctaacagatagaaataaattttgcaaagatcactttttgttagtaaaggtttggatttataattctttgttattttctcactgaagatcatttcgactttgtcattggatttgttatcttgcattatgttagtatggtgccatttcacattttagagaaaatgaaacctaacgtgctgcagaacacacacacacacacacacacacacacacacacacacacacaccacagctgcctatagtgaaacacattatagaaatgattcaattttatttgattcagagtgtcacttaaagtgttttcttttgttcatttgtagctcattttaaacacgtattttaaaatctactagtaaaggaagagaacataccattagcgctgattgggaagggtggttacttgaggatgtaaaatggctagctccatttcacattacatttaatatggaaaggaaagcataatactgcattaggaagagttaattctgactgtcattaatgctcagtagttctgcacatgtatgcagaaagctgctgttcttgttactccctgcacacactctgtgctcagtggagtgcaattgtcttggccccagcaattgctgagcaggtgacttgattatactgaaatcaggcagaaaatgtcctcttctggccactcgagtgaatcagtcaaattattgagtggcaaaactaattctatgccttgggccatcagaactgccacttcctataagtcaagccttcacttagtgtgaaattgttttttattttattctctttcatttattatgcttatttcagctaatctacttagtggatgtgaattagctcacgtgcttgggcaggtttagatatgcaactttctgatctagtagtgttaaaatattttagatttccaattcatttaacaaacatccaaaattttttatgatccatattgctgggagatacaaggcaatgcttgtgattttaaaatgaggtacaataggaaagaaaagattaaataagatgagatttaatgaaattttacttctactaaatttttcttaatagaattacagacatttaaacttcagaaaacgggaaattgattaaatgcagattcttaagtgagaaataatttacagttgcttagtcacacagttcctcttgtccgtctgtgaaacaaatctccatgcagttccttatatacttttgaatttctggctcaaattttatgcttattaacagtcattgttatcattgtcattaacaagctggggagtatttattcatgaatactactgacacgtgaaacccattttccttaagttagagaataccaaaagacagcatcttgtgtgcatgtgtgtggaaacttaaggtgtgctttagagttttatatgtctatcaacttctttatttgccatttgaatgggataaagtatttataccaaccatcttaaaatacttaacaaataatttgtataacatgtagttttctgttcacttctgcttatttcgtgatacataagaggaaaatgtactattttggggcaatcaaaaacctgaacttgagaccaatgttttaaagaatagcaaatatttgcttatatttccatgacagggagcattttttgagtgatctaacagattctgtgaagatttattctcctattagagaatgccccttaaatcttggaggagggaaatggcagttgaattgttgagggatttctgcctatacatattcatttaacaaaactagatggtatttgcagaagtgggtgagctatcatgtcagatattatatgtcacatgttagatgtcacacacatgcatttctttaggttaatggctgggaaaaaaatctcatgttctacatattttgtttgataagacatttgtgtattttgagatacacatgtatgaactcttttctcttggaacaggtatccaaataatatgatacatgtttaaaaaataataatgataatattttcccttgagacagcacagtttagatccataaggccattatcaagaaatagtctttggcatgtttaatagagttttgcacaatttgtaagtatagattcatagaactctagtaacatgtaagagaaacatggaatatttaaaatcttattttaaatgtacaattatttctgatacagaaatcaggagagaaagcctttttttttcttttatattctttcaggtataagttacgaatactatttatatttttttaaattaaatttttatttttgcctttctctgaaaaaacgatatttttctctataacaattttgaagttctgaagactttttgtacctggaaaatcactaaaagtatagtgaaaatgtagtcaaaattaaaacattttattaaatccacatctgacattactggtgtatttttaagaatagttatttagatgataaaatgtatttagaaaaaattaattgtgtttgattaattttaactttcacttttcaatttaatttctataaacagtttttttgcagccaaggaatacattaactaaaaattattattagtcaatcaatacttacatttaataaatgactagatttatactcataatgtaaatagtcctcaatcaacagtttctttgaagactgttatttatcaatcaaagatgaggcttattttcttggctcataaatgtgtatatctgtaaagataattgcagtaatctctgtattgataattgtaacccttggaatctaatggatgtcacttctgaatgcaaaatgttatacactagtgagatagaatttgagtgttgcataattcttggtgatacaaagaaaatcataatgaaagatgcattttgatatttttgaacttgaggtgaagcatatgaaaagtattcaagccaataaagaaagaatagagaggataattttgaatagttttgttttacatttttggaattttgcagtatcttataggagagaattgaattttatttatggaaaaaatttatttgaaattagtatgtttggggtttttcttcatggcaaggtggtagaaatgtttgagtatgttaagtgtagaataacagcttctaggagtaaactattagataaatgtaataaagtattctgttgcataatcggtcatttttcactgtttaacttagcagtgaaaactctattaaatcacaaggccaccaaaagtcctttatttttcttcatactagggccatgtcatgaggtccctgtgctattctcaggttgtaacaatctgatgtcattggccttcctagaggaaaaaattctgcacccagagatttttatgggtaaaagacagtctgtgggtaatgctgtttgttttctctttaccagttacaaaaagaaagtgccctatgcgaagttccatggtttatactttcatcaggtgtttgggttctacagccagaagactgactaaaagttagacctttgctgtggaaactgttgagcaccatgtggaaaaaaatggcctaattgttgtgtacctgataaatgtaattcctaaaggttgtcttacgtggagtatatgactgtttcaacaagcttttaaaaagtgaagggtgcaaagggggaatatggcttcagtgtcctttcagtggcaagaaatgaaaggtttgttcctcattaaatcatttattgatgtttcccaatagattttgagctgaacacttgttaatctcaaagctctgacaagcgaggcctgcaaaattaggccaaccactgctacaaatatctagtgtacatgaaacggtaatcattgctttccagtctattattagattaacttcataggaattgcttttttctcttgtgagttgatgcataaatggcatgctttatcctccaataaatataatagcagagtgcctatgacatgatgttcatagcccttggtcccatgacagattatttttgattgctgctggagttcagagcaacttgaaaccattagaatttgaaggcatccttgaatattacagcatacctaactcatacagaatactgctgactctgagttatgttcacagctttttgtcccatggtcttgactgtcactctgtgactaacttaagaaattatttagaaattctcaattgagttaataaacaattttacgacaagatgtaagagtggtatctccatctcttgaggattactagcattgctaaatgtcaccagggagagtttctgttgacattttgcatctaactatgttgaaacttcttttccttgttacgagttacattagaaaggtatgatattagatgccaagcctcttatacaggcaattctaaatacattctttctgtagcagatcagtaacttgtattttgtgttgatattttcttttcacctcaacatgcaacttcctttctgatgacttaaatccaatctgcttatcatttctcaatcttgtaaaaatggctcagataagcagttagtagaaactttgatatgagtgtgctttccccaggttgtggaactttgaagctttcaatgtatacaagtgtggttctaagtgtttcttggttctctgtcaatttaattttaggagaatctcatgttttatacctagggtgatttattttcctgagatatttttggtttatgtctgttttgatgccctatctagtttagtgttttatcactatctaaagtgtttttgtttgaaaaataaactatacagttatctttcttattaaaccagctaatctttatatgagtaaattgatctatgagtgtcttggggtttcacatgtatggaaaggaattgtaaccttattactgactctttctcttttttagccaatacctttaattcaacatttctcgacgtgaatataaagagacatataatacatagtagaccacctcatttcagatcttctatggagacaattgtaatactaagttgaatctaaaaagttggaggcattgttgcaccaaacattgatcttcaccctttccatgctaaaacagccataaagtaaaacatcatgtacctcagttttttccctattatcacaatgtgaagcactaaagacgtatttacttatatgtttctattcattgcattaggcatgggcattattgcaaagcaccccaggcagcacaactaatgagggagttaaggatggacctcttcttagggaagattaaaacgcaaaacaacttggaattgctttaatgagaaattttgagcatttaaaaatttgtaagtaacaatgcagtgcatgctatgaaaatgcatggtatgcctgactttagctgcacatgtagtcaagtgtactataattttattgagaaatgccttcattaattgtatagcaagatttgttacacatagaacctagagccaatgtgaatctaatttaatacaatggttatttttttttaataattgacattcctggcttctatgttaagtatatggtagcagtttgacagcattgaaagacccatagggaagcaaaaaatgttcccaatatagtggtgtttattgttatttatgtagtacattttaatgactaaatatgcatcagatgttacacagcatagtatataatcagggaccaaacaacagacacattgagggataagagcttatttcaaagtgtactagtcagggttccctagaggggcagaactaataggatagatgtatatatgaaggggaatttattaaggaatattgactcacacaatcacgaggtgaagtcccacaataggccatatgaaagctgaggagcaaggaagccagcccgcatcccaaaatctcaaaagtagggaagccgacggtgcagccttcagtctgtggccaaaatccctagagcccctggcaaatcactggtgtaagtccaagagtccaaaagctgaagaacttggagtctgatgttgaagggcaggaagcaaccagcatgggagaaagatgaaggccggaagactcagcaagtctgcttcttccaccttcttctgccttctttattctagccatgctggcagctgattagatggtgcccactcagattgagggtgggtctgcctccaccagtccaccgactcaaatgttaatctcctttggcaacatcgtcacagacacacccaggaacaatactttgcatccttcaatgcaatcaagttgacactcattattaattatcacaagttcacctcttgtcaacttgaacccatacacataatcctgaagttgacactcaatattaaccatcatacagagagaaaaagcataaatgttcatagttaatggtaagtagatgagtttagacattttgtaggtaggtaggaaagttttgtatgtatgtagatatgtttagaaatcaaatgaattcgatagggctcatttcaaatgatcaactataaaggtcagatgtgtaaaccactgattcctacctacttccaggttactgggatcacccccatggcaaacagcctttcttgatcatgagtttataaacacttcttaaccatatttgccaaatacaaatgattcatgggtaactatagggaaaaaaactccacaacacatgtctgagtactgaggtcagagcaccttatccagtgactgctcaggataattttttttttgcttgacaatgtgctttacagcaagtttcttgtgtgtgtgtgcgtgtttgtgtgtatgcttgcatgtgtgtgtgtgtgtatggcataatatgtgtttctataatgtagctaatttagaaacatttgataactcatatattttgtgttacataaatgtatgaacacaaatgagaagttaatacaagagttttgatgctttagttggattttgtatggcttttgtaagtatcaagtagaatggtgtaataatatcacccagaggcagtctgcacataacaataatgatattattaatagtaacaatctgtatataacaaaaacaacgacaacatatatgaagtaagtgtttctatcatctttgtggaaatgtattttgtgttttagtctcaagattttaaatggtcactcgttttattattaagttgtttgtcatgcatatactgaagctggaaacaatatatcagatagaaagttctacagattttttacacaggggcatatatagcatatagtaatatgtcttttatgaaataaatcatgtcatatattattctaattataattgatggattaggatgcagctggacaaaaggaagtatttatgctaacttcaattataacttggagagtaccaaaatgtttcttatcttctgactctgttacggcaatatgatgccatagaatgagattggattgagtcctatctaacgaccaattaagtattgtttctgataagccatttatcttctccaaggaatattttttcttctctgtaacatgtagatagtcatgcttgccctgcttatttcttaccttgttatgaattgcatatgaatatttaaatcatatgtgaaagcgttttgaatgatgcaaaatactgtatgtggtatattttttaaaaatattgctttgaatttctttgctttttgtcaattaatgctttactattactgtaggctacattttggaataagaaaatagattttgttggaaaatgaagaaaaacattttgattttatggatattatagtctagctcatgatgagctcaattttttttcttgaactataaaatatatttcattaccaccaaaatgtattattcatccactgtttatacccagatggtttataacatatggaataaatcaacacacctgcagtgtaacaggttcctcatgctatagcataatatcttaagtaacgccacaggatacttataatgacttcaaagctatccagaatcacatgcatactgaaaacattttattatttgtaattcttggatttgtctatattaaatgtaaaagtaatgagttttgtagaaagttgtcttttcacatgtgatcaatatgttttgaagctcacatatgttctcaggagttaatgttttcaatatttacaagagtaaatcattctggaggtcctagtgctatgtacgctatcagatgtgcaggcagccaccatttggaaaaagtcttctaatttctatcatcctgtagttttgtacaatttaaagcataatttatatcttggagaggaaaactgctaattgagatcatgtcataaaaatgtaatttagcaaaactgttagttttgggtattttactattttaagcaaatattttttaaatcacttgaatattaaataggttgtaaaattgtgttgggtatcggcacgttatgtcttcaaatgcattttaattctcattttcctttgtttaaatagtgaaaactttataaattagaaactacaattaattgaataaactccaataggacatttttgtatgcatttaaaaaaatgtaacataaatattttagagcttttgatggtgggtaacgtgtccatccctctggattttaatgcagtaccaggggaaataatgctaatatcatgtgaagcacaatttattttcagtttttaagcccatcatggttactcagttaatatatactttaatgccggcatctaaaatatctaaattagattttaatagcaagatttcccaaccaatacagaaactatgattcgtgccatagctatttcatcccacagactcccaaaataccttatgtgatgatgagtaaaagagaggcatttgccaatttaatgacatgttttctgtatgcttcagatgcctttattcattttaataacagaactcatagaatcctagaagtactagaaagcttgcaataggggaagctctcctgtttttcatacaaggaagcctctcaatagggtcatacaatggtggggagggcctaactctcatttatcgacctagaaagccaatcgttgcctgttctggaataagagtgctaggtgctttacatctcttatctcatttaactcccgtaagaactatgaggtaagcgttcattatctcttttgtgtagatgaggaaacagagaagctcctagacgtcacactgctagtgaatcagtgccaaatataactggcttttcaaagattgggttcttaaatactaggccacattacttttctcaagttctaaatattggccaaaagaaaggccctgttttggtatctgctagttagtgtagaatataagaatcacagaaagataatgagctgtttctagtccttgatgcacctttagccagattttgaactgaggtaaatcacttaactttattgttgtatcatctatcagatgggaatgatagtctctgcatatgggtcattgggataataaaattaggtgagagatgtgtattagtcagagttctacagagaaacagaaccaataggatatgtatatatatatatatatatatatatatatatatatatatagagagagagagagagagagagagagagagagagaagaagaaatgtactacgggaatttgctcatgcagttacggaggctgagaagtcttgcgatatgctgtctgcaagctagagaactaggaaagccagtgatgtaattcagtccgagtgtgaaggcctgagaaccagggagcctatggcataactctaagatctacatcaaggtctgagaactgaagggggctgctggtataagtccaggagtctgaaggcctgagtgcaaagagttcaggtacctgagggcaggaaaggatggatggtgcaactgaaacaaaagcaaattcatctttcctcttcctttttgttctatcttggccctcagaggatgggatatctacccacattggtaagggtggatctcctttactaagcttactgattcaaatgctaaacttttcctgaaacaccctcacagacacatccagaaataatgttttatcagctatctgtgtattccttaacacagtcaagtgaactcataaattaaccatcacaacatgtgggtgggcttttaaaaaatcttttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgtccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgcgggattacatttattgatttgcgtatattgaaccagccttgcatcccagcgatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaagattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagattccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcttgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgattctttatccaatttgccagtctgtgtcttttaattgcagaatttagtccatttatatttaaagttaatattgttatgtgtgaatttgatcctgtcattatgatgttagctggttattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaaagttggcctgccttgctagattggggaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaaatggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaagaaggggaatatcacactctggggactgtggtggggtcgggggaggggggagggatagcattgggagatatacctaatgctagatgacacgttagtgggtgcagtgcaccagcatggcacatgtatacatatgtaactaacctgcacattgtgcacatgtaccctaaaacttaaagtagaattaaaaaaaaaaaaaaaaaaagagaattcagcaaggattcaggatgccaaatcaatatatggaatcaattgcatctctatataagaacaataaataaatggaaaatgaaacataaaaaaaaaaatcttttgaaggtgttataaaaatgaatttatattccaaaggtaaagcttcccaccaacacatacttctttttttattcattttttgatatttgggagcaagatgatattttctcatttttcttttcatgggggtggccaggtattaatagtaactattgtactgtggcctgtcaggatggttgagttttcaagaaggtgacacatgttttttgttttgttttgttttgttttttgccagtaaaatttgttttatttatttcttcttccttttttccttctcaatttatctgtggcaatgagattgtctatttcattgagaaaagatagcacaatttcacttcatttgaaagaacgtgggatgccatcctaattatgtgacttatgaatggtatatgcttgcaaagaaggattaggaaagtttggaggagtgaagagcttttctcattttaaccagacagtatatctaatcataacaatctttccaaaacctcttaatctaaatggtctgcatttcacatttgagctccctatttaatgctgcttaaaattgtatacacatataatacatacataaattcaccaaattaaggttttctctctgtgtgtgcatacagatattttgtgtgtatgtataaaactttggtattctagtttttaatccaagagagttttaatccaagcttaggaaggttttgtttgagtaaagtatatgaatatgcagtttacaaaaaggcacatgatcttctagaactctgcttttgcatgttattatttctaatgactacatgatatgttgataccttaactgtattgcatcatgaacgcatgtttctaatacttaatttccttattcaaaatccaacatttacttggaaacaggtaggtgaaaagatagcaacataaatatgattctataaacatttctctttatattagaaggtagaaattgtaaatcgccaaatgataacttgaaagtaatatacagaatatttggaattcatgactatattttgctgcactagacttagattggtctaggtttcttaagaaaggagtgagggaaatctagttttgtctcatgttcaccttctttagggtaattatctttttttttttcctgaaatagacaacactttataagtatggtatgggtactaagtagagactgatcattggatttctacaaaatagtagggagttttaaaggagtcaatgccgttgacctaattttaaggaaattttattattttgtgtacagttatagcaccaatgaagacatatcacagttatttttggatttcaagtaaatgttaaagaagaataatatattaattttgtggtcttgaccacttacatgggtattgccaccttgatagttccactagttgtaatacagggtttaggtataaaacaacagctgtgtatagatccaataattgtaatattgaaaataatttgaaattaatttgaaaatgtaatattaatattatcaaagggaaagatttcagactattttgagatataacaatgcaaatatgatacaatgcttattattgaccaagggacccaacattatgtaattaagaaataaatggaatgtaagatgtccgaccaagagaacacatgtagtcatgtaagcagtctcatgttttgtcttactccagtcactcactagttctgtgtccttaggaaagtcttttattttctcaggacttcagtttttagtatgcactgctatctcccatgtctctcctaagttccattggcccacctctgtaaaacaccatacaaacataatgtgcgattattggttgtattacaagataaataatattaccggaattctaacaaatagctataaaaatcacaatattttattgattatacaaatacattcccttatttccacatttttatgttaccttacagaaatctgtacctcttaatttttaaaaattttctcacttaacccttcatatgtactacatcaatatatacttctcacagaagatagtgacattcaagagcagccaataaaccttaagataactgaaggaagaacactttgatgtttcctatttttcttcctcaaatatggtataaaatctgagtcaatgccgtattgacacagcttttctatttgctatcatttataaattctgggattacctgagtgattgttttctcagaaaaccataatgtgatctccaacctaatactccaactatcatgcactaattaaaactgcaattatattttttctcaaacaaaacaacttaataaacattattgcaaactgtttacccttccccaaaacaatttatgttcactaatacaattttccattaaaactgctgccaggtacattaaaaactctggaaatagtaagtaagtgggaaattaattcaacagtttaatctagacctaataacacttgcaagtgcagaaaaagattgctacagtggggagttaattaacagcttattccccatttgataaaagtaatccactttaattccagtgtaatttacctcaatgtaatataaaaccacaagctgcctctggtgctggtaattattagctttgtcctgtggccacattgacagtaaaagtcagcagtatcttaataataagagactgtctgctaaacacccacaattaaagatgtaatatgaaatcttctaacagcagcaaccatgtgtattgctatacaagcagggttgcagtggatttaaactgcatttaattgttccacctacttctagaaagcaggtgtggcatgtgaaaagtaagcattttattggcttcatgtaaggaagcacagggaatattagtgatgagttcatcccattgttttccttccctactaccactgtctcagtaaagctatcatctcttttcacttagactgctgcacaaatctatgcagtttctccacccgcttctcactccaacccatcctctatgtagtcagacacacaaatttcatcatgtaaccttcatggatataaaccttcattgacattcatttattgttcacaagatgaaattgaaattctctgcatgatgtaaaagtggttccatattctgccctcaatctaccattcaaaccttatttatcaacttgaaaaataaagaagataaattcatctgcctgcagtaccctttccttgcttatctcctatctcctctgtgaagttttcttagacactccccatgaaaatttagtcattactttttctattcttttacaatactttatattcacctattatttcacttttcaaattgctgtttatttctattaacatgtctgtatccacctactagactagtggctctcaaagtgtggtccccggaccatcagcattagcattacttgggtacaaatttcgaagcaaattctcaggcttcaccccagacctactgaatcaaaaacattggcagcggggcccagcagtctgtttcaacaagccctctgggtgattctaatggatagtaaactttgagaaccagtcttgactgtgagtatgttggggatatatacagtggcttattctctttttattttcttcatctggccgtttatagcacatagaaggtactcagaaatattttttgaataaatgagttatgatggaataagtggtagcaaaaatagaaaatctagagaaggtatggaaacacaagtgacttccaagttgctcctttatctaactaaaatgaaaagtctgtgtttctctgagagagtagattatttaaataggaaaagtcaagaatctaaattattatcaatatttcaagtccttctgtacaaaaaagaaaaatcacacagaaatatgtttgtatgattgctgatattctcaataggttaatctagtttcttttctctttggaagttatggtttgtgtaaaaaacatttagactatgttaggcagccaatatggtctaattcttttaaatgttataattatttctctttttaaaaaactcacaacttttagctaacactgtgtgttaaatgcaatagcatatgttgtatgtacatattattttggctgtggacactaaactaaacaatttgcttgctattaactgaattctttaatatagataagtaatatgtagataaattagatcattaaaaataatagactttctcaaactacaatgaagtcatttaaaagtacatttgtgtttcttatagtacatgaattccaattacagaagtaaagtaatgtatgttattatcccacaacattagatgttagcaaggattaagtgttttttattccccattattgcctgtaacatttgtttataacaggagtccatttgagcagcctccttctgggcttttaatgcattctttagaacgagagtgacttttgaggggagttctatcagatagaaaagccaaacaaattcaagtgatgttgtaatgcaacctttctattattctatctagaaaatgtatatgattttcaggaacagaaaataagccttagtcgattaaaaactgttagctattgtgtaggagcatcatacattatactgcttatgtagatatatgtaaaaacagatatttgtgagacatgaatttatgtgtatgcccatactacgtggttacctttattgtgacctttaatgacggctattttaaaagcaaactgttctgtacatgcaagtgtacttcatcatcatcatcatcatcattataatgacctaataacatctttgtgtttcaaaataatttcacattcaatttcttatttcttttatcctcgcaagtatcctataaaatactcaaagcagatattatccttattttgcagatgaagaaaccaaaatcagataaatttaaatgaaagacaaagctggaattagagcccaggttgcctgaattctacttaagtgctccttccactttcttacacttctcttacatatgtatgaactccgttgaccaaacatgtacagagtgactactatatgtcaagaaatgtgcttggatatatttcagtgtggtgtatttcagtgtatgtcttgaaggacgggtagtgtttggatatttggtaagtaaagaggaaacaagcttagggtggaatgagggtataatcaaaacagatgtggtttaagatgaggcatgttgaagaatgggtgatgaataaatgattcactttagagaagagtggaagatgaagttggaaagataggttgtgatttattgtcatgattatcttttttccaaactggagttctaaatttattccatagtcaataggaagccaatgaaactctttcgaacagaggatactggaacaggaattttaactggatttatctggcagatctaggtggttatgttggagcagagtggtaggtatgaagagtgtctggagcttgggctctaattagcagctgcaataatcccatcttgaggagataaggcctgagctagaatatcagcagtggccatagaaaagagtaacatgtgcgttcctcctttgtacatgtatggaatgtgcttactttctccctcgtttataagatttttgctagttactatatacagttttaaaaatttctacatatctcccacagagcttggcaagtacagtgccgtgcttattgtaggtgtccggtaaatattgttaactggccagctgtttgaaatgttcacagtatttgtagtagacgaggctgtaatggcatttattgttaaactgtagggttggtcattgtggctgagttttttaaaagtccacacttcttggtattttcacaaatgagctgaaaacttacatccaaacaaaatctgcatagtgatgtgcatagcagcttttttttcatagtttccaaaacatgaaagcaaccaagatattctgcagtaggtgaatgggtaaataaattgtggtacatcaagacaattgaatattattcgctgctaaaagaaatgcaatatcaagcaatgaaaagacatgggagtagcttaaatgcatattgctaagtgaaagaagccaatctaaaaaggccccatactgtattattacaatggtctgacattctgtaaaaggcagaactatggagacagtgaaaaagagtttggagggaatgagggattaataggaggatcacagaggatttttaatgtgtcaaactattctgtataacactctaattgtggataaatgtcattatacactgcgaaatcacatagaatatacagcactgacagtgaaccctaatgtaaactcagggttttgggtgattaagatgtgtcaatataggttcatcaattgtaacaaatgcaccactctggtgtgagtgactgggagcctgcaggggtgttatgatgtatggagtcaggtggtgtatggatctatactttttttctcaattttgctatgaacagaaactgctctaaaataaagtctattggaaatcaaaacaaaagaagtcaatttgctattaaaactttcagtaattggtgttaattaacatatgagtcaagagagaggaagactaaagtggaaggttaacagtgagtgtttgagttatctgtttttagaaaagtaatatcaaaccttcctaacttttctatagattatatggatgaaaatataaggtgtgaagtgtcaagttgtgaaggaaattcttttttcattcatgtttgcggcctttgtgttagattcctgatgcacgaatggggctgtgtaaagctatatgctagacactactccttaataaacatgaccattcctttttgttattttgttatttaaaaagattgacatgtgggcagtaaaataataaagtaaatatcaaaaacccacagttatggagacattgatttgggaagaaattcgttacgtctgtcttgatcacttccgatttcaccttctgggtattttcttcttctgtggttctatttatctcctctcttctgtacagaagctcctctgtatctgagcatatctaaaactcacaaggttttacataaacacatttgtttttaagttgaatgtgacagacaagatttagcccacagtctttacatgcatttttactaaatggtactgtgagttggtccttcagggctttgatatcagtcaaactcttgtcttccttactaatactcatttcaccaagcaccttttcccaaagtaagttagatttggtttgtgataataacgtgttaagtcaggtaatgctcatcgttgatgagcttcacaattgccctagggaacttcttagcagcccactttaatgctgtacggatctaatagcttttgaaattatgaagccatccatgacttgtgacaaaggtgtaattagaagcactttctccatgcttaacctttaagttctcaaccatttgcattatcaaaaacaaactaaccaaaccaaattgaaatgaaaatatatcgtttctaaaaaaggagaggatgatcaaataccaatacagatcattcacctgagctccagattatacgttcacccatctactgggtccctacgtgtccaaaatgcgacttaaactcggcattttgaaagtcaagctcatcttcaccctcaacaatttatccttcttctaaaactataaaaaccctagaagaaaatctaggcaacacccttctggacataggcatgggcaaagatgttatgatgaaatctccaaaagcagttccaacaaaagccaacattgataaatgggatctaattaaactaaagagcttctgcatagcaaaagaaactatcatcagagcaaatagacaatctacagaatgggagaacatttttctcaatatatccatctgacaaaggtctaatatccagaacctacaaggaacttaaacatatttacaaaaagaaacccaaacccattaaaaagtgggcaaaggaaatgtacagacatttctcaaaagaagacatttatgtgaccaacaaacatatgaaaaaaagatgaacatcattgatcgttagagaaatgcaaattaaaaccacaatgagataccagctcatgccagtcagaatggcaattataaaaagtcaagaaacaacagatgctggcaaggtgtggagaaatagggacacttttacactgttggtgggaatataaatttattcaactattgtggaagactgtgtggtggttcctcaaagatttagaactggaaataccatttgacccagcaatctcgttactgggtatatacccaaaggaatataaatcattctattacaaagatacatgcacgtgtatgttcattgcagcactattcacaacagcaaagacatggaatcaacccaaatacccattaatgatagactagataaagaaaatgtggtacatatacatcatggaatactatgcagccataaaggggaatgagattatgtcctttgcagggagatggatgaagctggaaggccattatcctctgcaaactaatgcaggaacggaaaacgaaataccacctgttctcacttataaatgggagctgaacaatgagaacacatggacacagggagaggaacaacacacactggggcctgttgggggagggtgaagcgggagagcattaggaaaaaaatgcatgctgggcttaattcctagttgatgggttgacaggttcagcaaaccaccatggcacacgtttacctatgtaacagacctcacatcctgcacatgtacccagaaacttaaaaaaaaaagtctgtttaaaatgctcaaaaatcttttactcattttaaaaattgggttgttggttttatattattgttttgtaagatttctttatatagtttggatggaagctctttgtcaaatatatattttacaaagattttatcccagttagtcatttgtcttttccttttcctgtgtttttcaaagagctgtagtttccaattctaatgaattacattatatcaaatttttattttatagtttgtgattttgttttgtataatacatttttgcctaacacaatgacacagagattttctactgtgttttcttatagaagttttatcatttttgcttttatattttaatatattatccactttgagttgattattttttgtcttatgaggtaaactttgaggttttattttctacatgaatattcaattttcccagaatcatttgttaaaaatcttttccacagggaattaccttggcaactttgttggaaattcaatgaccatataagtgtgagtctatttctggaccctctattaggtcccatgggtttttattctttttattattattattatacttttaagttttagggtacatgtgcacaacgtgcaggtttgttacatatgtatacatgtgccatgttggtgtgctgcacccattaacttgtcatttagcattaggtatatctcctaatgctatccctccccgctccccccaccccacaacagtccccggtgtgtgatgttccccttcctgtgtgcatgtgaaatggatgaaactggaaaccatcattctcagcaaactaacacaaggacaaaaaaccaaacaccgcatgttctcactcataggtgggaattgagcaatgagaacacatggacacaggaaaggtttttattcttaatctcacatcaggaccccactgtgatgattattgtagcttgtaagtcttgaaatcgggtaacgcaagattttttttttaaattggcaatcctaggtcttttgcctttctctataaatttaaattaaagtaattaatttcttctaacaaagcttactaagaggatgtgattggaatcatatcaaataaatagatcaatttggggaacactaccatgttaacaacattgaatcttccagtgcatggacatatatagctctccctttaagtattattttatttccttcataaaggaatgctttatgatttttagggtacaaaacttgcacatatttcactaaattcattcctgtatcttgttgatgcctttgtaaatatagattttttaaaaaaattcaaagttcaatgagaacacttggacacagaaagcggaacatcacacaccacggcctgttgcggggtgcggggaagggggagggatagcattaggagatatacctaatgtaaattatgagttaatgggtgcagcacaccaacacggcacatgtatacatatgtaacaaacctgcacgttgtgcacatgtaccctagaacttaaagtataataaaaaaaagatagacaattcttaccatactatgccaaactccatctattctgttaccattaaaggaaatattgaaatgcaaaaaaaaattcagtgttcaaatgtttattgctagtttgttgaagtgtaattttttgtttattgatgttgtatactatgagctcactagattcagctattcattttagtagctttctgtagaatccttaatcttttctacatgcatgttcatattatttaggaataacagcagtttcactttttctttttcattctgtatatcttttacttattgccttatttagctggataggacctccagtaaaatactaaatagaaatagcgagaatacacattcttgcattgttcctggaaagcatttagtatttagatattgagtatgatgttggctatagggattttgtagatgcccattttcagattcatcatatgtatcaggtcttagttctcctaaacctgccatactgcttcaaacctctgttactttacataacctcatttctccgtttgattcagatgttgtgcctaagcttcacctagctaattttaaactcttattactagtctcaggaagctcgtttttttcagcaaaagctttagtgatttcacatgatgctccctcctcccacccaccactctgtgccccattaccaactgtgtcatgtgttcttcctttgtcattgaaaagtaccaggcaagtgtagccttccttatgtttgctaaatttgatttctgtttgctcttatttaacttaggttactgagttctagggcttggagcatttatctctgcattttcagtcagtgcccagtacatagaaaatgctcaacactcactagaatgaaagaagcaaaggaaagatcaaaggaagagaggaggaaagagagggagggaggaaagaggaaagggggaaagggatagagggagaaaagaaggcaagaaataagggaagagcagaaggaaaagataagggaggggagaggcaaagaacttttcagtaaatatcaccactggtagttttaattggagacaagagaactgaagagtgtatgctcctagaagagacctggatctgactcacttctgccattcatattagaaactggaaacatcaatccttaaaaacatgtcatcattaatcctctggggctctcccatgcattaggaagatttacaaaaataaatgatgtgaagaaattcaaagagattgcttgttggatagcagtgatatattccctagaagccatagagatagttcattgcttggcctagacccatgctactgacactcagtccaggcttgtattggcatctcctaaaatgatagaccctataaattgaccagcctccacctgtgtgattataaatacctggactgaagttttttcctccataggttttattgttctcaagaatagccgtgctgccagaggaaaaatgtaatgtacttacaaatataaagcaaatactgtgtgccattctatgtgcctaattccacagtactattcaaactacttctgtccaactgtatgtcctcactcaactggttttaataccatgttacccctactcaggctgcaaatacttttatgtcttctcaatacagccatacaatatgtgcatgctttaaataccatgctccccttaaacgcggttttagtcatgactcttctcctcctcgttaaagaaaaaaattcagcatattctaacccaagtgaaaagcacagtattattgaaaaatcttattttatatttgcttatgtgctgaatatatctaaatgaccgaagtgtttaggaagtatgacctggtacctattctgatgtcacttattcagtcagggcataatcttttattctgccatgatggaattgaagttaccccaaagagtagagtaaaactactcctcaaattgggtggaatttgttctcaaaatacacacaaaattctgattactccaagaggctcctggtaatctaaacctggggaaacagcttttaggcagctctgttcaaagcaggtcttctttagtagctatataaacaatctctctcggttgacctaatttttaccagccaattaaaactatgcatcactaatgcttactgtggtgacatttaattggtgaagcctgcctgaccctccattattattactctgacccattgatcttaaaaattacaaacctaaaagttcacctataaatatccttcatattaagaaatgcatgtgcctaggcttagagatatacatattgccatttttgagattttcagtatgtggcttctcttctttttcacactcaatatgtataaccatctatctgtgcctggacaagtatggagagctatgcacatacattctggacatttaaaactttaagtattttaaatattaaaataaaggaatgtattgttacatgtgaaatttttgcattgtttattaaataggagtttcaaagcaagttgggaaatctattttaatatgcccttatgctgcagcaatgtttcagtggagaaggacagaatattttaggttcaattccctaaacctgaactctttcttatcaggaatacatcaagtattgataaactgagatgtgtacgttagttattctctctttatataaaatgtatttgttagtagctcatgggcatatatgaaatctcaagttaaaaaatatctctcatggtaaaacaaaaatagcttacaaatatttcttaaatactaatttatgataaatattttacagttattcctatatcaatatgagagatgggtgaaaaatatcttaatggaaggaagaaatttcttctttaagtgaatgtggatcattggtttgctgatatgtcaggttgggcacttgctcacaaagaacagtgtttccattttaaacatcatttcagtgaggtaaaaaaataatctgtgaagactgatgccaactttaaactctttctatagtagatttggcacttgagagcaatcttttctttacaaattttaatgaccaaaaaatcgatctggctttcccgtgagtcacagtgaattaaaaacaaattgttcattatgttcagctgcaatgcaatggtggggggggaagcttaaaatcccaaaaagtgaccatgatttcaataaaagttggcaagtgattattcagttttagttgcattgtatatgccatttaaaagaaggggcctaagaaggtgatttaacattgaagtatattctacctaatttgcaaatgaattttatgtggtgctcctaacctttttaaaaattctctggaactccattataacataattgttcataggtcagaattctataaaacttgaattaattttatgcctaaaagagggtatagttattaatgtaatagaagaaaaagcacattaaaacacattgaaaatacaaggctacttgtatacacaagtgcacaataagtactgaagatcaatcatactttgatgttacagtgtgacatggtcagttcagctaggtttcacaccatacaagtaaagtacatgttgtaggattctgggagaacttagtcccatggtcatagatggtagcctcccctcaaccaacacttgtattaatatgcgatactggtcacagaaaaatagactgtataaactgtagatggaacaattaatatctttactagttatgaaaactacctactggttacatatatgcatgtgcagatgcacagtgaacctgcaagatgttacattttgaagtctaattttcaaaagaaacacaatgtaattgtgattattcctttcttcatccattcattcatttactcaacaaatacttaaagccttttttggtccaagcactatgataaacatggagcatgaatagataaagaagatagcatttgtccttaagagcttaaaatctgtagtagtctaaaatcattcacaaatagtcaatgctgaatacaaatactgtaagagaggcaaaaaaaaagttacattacatttttgtggggcaatcaggatatgcattacaaaggagatatgtgaatgctaggtacaagaaaatagtacctgattttgcctaatatgcattaacatattttactctaactttataagggcatcctttttaaaaacatacatttttattggtgtttgttaaaatgtgtagtctttccttgaattcaacatagatttcaacatgaaatatgcacaacataaaatatgtgaaatgttcttggggttagaaaagttttactgcaaacgattatttccagtctagccattctgtttcatcatctgcataaggggttgatttcaaagcaacatttaaaaattttcttttcaaaatttcagacctaaaccaaatactagataccatttgcttcactcattattatacaccatagtttggatgcttgttctccaaatatcatgtgaaaacttgatcctaattctgaaggcagggcctactaggaggtgtttgggtcatagggtctgattcctcgtgaagagatcaatgcctcccttgggggtgagctctctttctgttagttcccctgagaactgactgttgaaaagaacctgacaccttcctcatctccctctctcacttcctcccttcccatataatctctgcacacaccagctgccttttgccttctgctctgagtggaagctacctgaggccctcaccaaaagcagatgctggcaacatgcttcttgtatagcctgtagaactgtgagccaaaaaactacttttctttattaattacccaatctcaggtattcatttattgcaacacaaaatgaactaagccatcgtaataactatattcaagaaatatttactttatactatatgtcaggtactacaatgggtaaagcatctaatttagataccaaaccaacggcagttactattaatttcattttctaaagattttggggatgtgcatttctttgtttctgagtgcttgtgtgtgtgttttgttttggagcaaaacaggagcagttagttaagatgggagaaaataagaagtagatgtctttcaggttgtttttaataggctattataattaatactatagccttctttatagcaaaattctctattatttagaatcttaatctacagtgctcctccattaaattttaacatttaaaattttattttaataatatggaagaataggctttttataggattttatgaatattttaaataaaagatataaaaatatttttagatttacagaaatgttgcaaagatagtacagaattttcctctatacttttgtgatattttaaaatatttgtttggtctttaatgatttcctggcatacaactactaaaatcctcagaatctccaaagtgatgcctttttgtattctaatgagttgacttatggctggcagcccctgggggtctagtcaccagaaagaccaagccatgattggagggcagaacttccggagagtgtacaaaggctgaagattaagttgatcaccattgaccaatggtttaatcaatcatgcccacctaataacgtcttcctaagaacccaagagggctggctatgtagagctttcggattgttgaatatgtggagggtcctggaagataacatgtccagggaaggcctggaagcttcacaccccttaccatataccttgacctattcaaatatttgatctgattttagtatcctttgtaatatcctttataataaactgggaaatgtaagaatttacatgagttctatgagtggcactaagaaattaatcaaaccacaaatggggagtatgtgaacccaaacttgaaacctatgggccagaactttcagagacccaggcttgattggtgtctggtggagaggtcagtcttgcaggactgagccctcaatctgtgggatctaatgccatctccaggtaacagcagcattaaattggaggaaattcagctggtgtcactgcagaattgattgctttcttcttgttggagagaaatccccacacatttgatctcataactctctgtgttcattgttgtgtggtgtgagagcagaagaaaaataggttttttttttttaacctccgacattcgatttttcctgttgttagcatctcaacattactatggtatatttgttacttttgaactaatattgatacattatttgtcactaaaatccattatttactcagatttccttggttattaattcatatttatttggttttgccatttcaagaatgctatataattggaatcatagaatatctagctttttcagactggcttccttatttagctatatgcacttaagattcatccatattgttgtgtggactggtaggtcgttccttttgtatttcccaacactgtatggacgtactatagttaagcctttcacctattgaaggacatcttggcagtcaccatatttttggtgattatgaatgaagttgctgtaaaaattatagtgggggttttcttgtgtagattagttttcagttcacttgagtgagtatgtatcaaggaatgttattactgggttgtatagtatataattgctacattctctttcaaagtggatgtagcattttgtattcccaccagtaatgtttgttctagttgatcttcatctttgacaagttttttaaatcaatatatatatttctaaattttagccattctaacagatatcgtggtatcgtgacatgaatttactttgcatttccctaattgctaatgatgctgattattttctatgtgcttatttttatctgcatatattatttggtgcagtatgagtatgtgttcaagtttattgttcactttttagtttttttttttttgagacggagtttcgctcttgttgcccaggctggagtgcaatggcacaatctcggctcactgcaaccgccgcctcccaggttcaagcaattctcctgtctcagcctccctggtagctgggattacaggcacctgccattatgcctggctaatttttgtatttttagtagagttgaggtttcactgtgttggccaggctggtctcgaactcctgacctcaagtgatctacctacttcgtccttccaaagtgctaggattatagatgtgaggcactgcacccagctaccattttttagtttttttaaactggagttttgaaagctctttatacattctgtatataatatatgtctctcaggtgagtggacaaaaaaaaaatgcactgtggtacatccatacaatgaaatagtatttagagataaatacaaatgaactacctaccaatcagtgcaatgatttgaatttgtgatttgaaaatatttccacctattctgtagcttgtgtttttactctcttaaaagtgccttccacagaacaaatgttattaatttttatgaaatccaatttattattcttttcagtatggatcttgttattgttttacatttagatatattttatattttgcataaagtgtaaggtttaggtagatgttcctgttggcatatagcttgcaatttttacatatcatttgttgaagatgattgttttccattcaaaaattagttagcactttgcttacactgctataccaccacagcctacatgcgtgcagcctgccgtgctgccatggctgctggcacatgcaagtgagcacagattatactgcagtgactttgatgaagtgctttggcatgcaccacccagaggagttcggtggccagcacaccaggaacacctcagcccctccagtgcagcaggtttctaaccttgaggggccagtgaacaaagctgggagcccagtaccagctcatgagagtttgagcatgcagaccaggagctcttacttgagtcttagcccgctaaaatcttccagaaatgaagccagttgactaaaccccaccttatactaaaatcaaacccccaagggcatcaaagaagataacatttttaaaatcccattcaaaggatagcaacttcaaacactgaaggaacattagcacacagaaatgagagagaaccagtgcaagaaatctggcaacttgaaaagccacaacatcttctcacctctaaatgactgtactagttcctgaactagtattgaacttaactatgctgaaatggtgtaaatgacagaaatagaattcagaatatggacacaaatgaagattattgagattcaggataaaattgaaacccaattcaatgattctaaataataacaaaaaataacagaggagatgaaagatgacatggccgttttaagaaataaccaaactaatctgatagagctgaaaaactcacatcaagaatttcataatacaatcacaagtaataacagcagaatcaaccaagctgaggaaagaaactaagagcatgaagactggttctccaaataagtcggtcagataaaactaaagaagaaagaataaagaaaaatgaacaaagcttttgagaaataagggattatgtgaagagtacaaatctagcactcattagtgcccctgaaatagggagagaaaataagcaacgtggaaaacatatttgaatatatcatccataaaaatttccccactattgctacaaatcccaacattcaaattcagaaaatgtagagaacccttgttgaatactgtacaagatgacaatccccaggacacatagttatgaaattctccaaggtcaacatgaaattttaaaaaattaaatgcagctagagggaaggggcaggtcacctacaaagggaaccccatcaggctaacagtagacctttcatcagaaaccctataagcagaagcgaatgggggcttatattcaacattcttaaggaaaataaattccaacaaaggatttcatttctggccaaactaagaaaggagaaataagatccttctaatacaagcaaatgctaagggcaattttaccaccagatctgccttctaagagatcctgaagggatgctaaatatggaaaggaaagaccactaccaaccacctcaaaaacacacctgagtacatagatcattgacactatacagcaatcacacaaacaagtctgcataataaccagctaacatcacaatgacagtgaatccacacataccaatattaaacttgaatgtatgtgggctaaatgctccagctaaaaggcacagagtggcaaagtgggagaaataagcaagactcaatggtgtgcagtgtttgagagatgcatctcacatgcaatgacacccataggctcaaagtaaatggagcttggagaaaactctaccaagcaaacagaaaacaaaacaaaacaaaaaaacaggggttgctattgtaattttacaaaaagcagatttcagtacaacaaaaagaaaaaaaaataaaaaattggcattacataatggtaattagttcaattcaacaagaagaagtaactatcctaaatatagatacacccaacacaagagcactcagattcataatgcaagttcttagagacctatgaagagacttatataaccacacaataattttgagcgggagactttaacaccccactgaaagtgttagacagattattgaggcagaaaactaacagagatatttaggacctgaactcaacacttgaccaataagcctaccctaaaacaacagaatatacattcttttcatttacatatggcacagactctaaaattgaccataaaatctggcataaaacaattctcatccagttcaaaacagaaattatgccatccacactcaaagacaacagtataataaaatggaaatcaatactaaggaaatctctcaaaaacatattacattacattgaaattaaacaaccttctcctgagtaacttttgggttatcaatgaaattaagacagaaattatttgaaacaaatgagaaaaaaataaaacaaactagaatctctgggaaatagctacaggagtgttatagaggaaaatttatagcactaaatgcccacatcaaaaagttaaaaagatctgaagttaacaacctaacatcacacctaaagggactagagaaacacaagcaaaccagcaatataggtagcagaagacaggaaataaccaaaatcagagctgaaatgaacaaaattaaaatgcaaaaataaaaaataaaaaagagcaatgaattcaggagtttatttttttgaaagaataaataagattaatagactggtagatagatgaataaagaaaaaatccaaataaacacaatcagaaatgataaagtcatatttccattgaccttacagaaatgcatgcacacacacaaaaaccctcagatactactatgagcatctctatgcacacaactagaaaacctagaattaaatgaatatattcctggaaacgcacaacatcccaagattggaccaggaagaaattgaatctcctaactgaccaataacgagatctgaaattgagtcagtaataaaaagcctaccaaccggaagaagcccaggaccagatggattcactgctaaagtctaccagatgtgtaaagaagagcgggtaccattcctactaaaactatttaaaaaaaaaatgaggaggagaaactcctgcctaactcattctatgatggaagcatcacgctgatgccaaaacctggcagaaacaacaacaaaaaggaaaattttaggccaaattttttatgaaaataggtgcaaaatttctcaacaaaatactaacaaaccgaattcagtagcacatcgaaaagctaatccaccatgatcaagcagagtttatccctgtgatgcaaggttgattcaacataagcaaattaataaatgtgatttatcacataagcagaactaaaaacaaaaagtaaatcatcatctcaatagacgcagaaaaggctttcactaaaattcaacattccttcatgttaaaaaacccttaacaaactagacattgatggaacatatctcaaaataatagccatctatgacaaacccacaccccaaattatactgaacatgaaaaaactggaagcatttcgtttgagaactggaataagacaaggatgccaaaccttatcactcttattgaacatagtactggaattcctatctagagccatcaggcaagaaaaaaaaattgaaaggcatcgaaataggtagagcagaagtcaaagtatctctgttggcagatatgattctatacctagaaaatcccattgtctttgcccaaaagctccttgattcaataaactacttcagaggaaattatcttctatttctatttgctgctttttttaaatttttttaattttattattattatactttaagttttagggtacatgtgcactgtttttttttaaaccatactttattattggattttgtcaaatgttttttttcatcaattgataagaccatacggtttttcttttttagactgttaatgtggtgaaatacatatattaattttcaaataaataaccagccttgcatctcaggaataaaccccacttggtcatagtgtgtgtgtgagtgtgtgtgtgtgtatgtatatatttgtagaactgaattctgttaatatttcttaagagtttatgtttccatattgttgagagagattcatatggagttttctccttttttacactatcattttctggtttggttatgagagtaatgcctgcctagtaaaaagaaattggaagtgttctcttctcttctatttcctagaagagattatatagaattggtgctatctcttatttaaatgttgaatattaatagaattcaccattagaatcacgtgggcccggagatttgttttttgaaaagttttcaactatgaattcaatttctttgtttcaaatttttacttaatttcttttatttaatttgaacttctttgaagattttagaaataggctgtctctgtgcaatctatatcagtttgggtgacttctggtggtttgcagtttttaaggaattgttcttttttatttgaattttccaatttatgggcacagatttattcgttttattctattattattatcttgaattattctgggtgtttaagatattccctcttttatttctgatacctttgccatttttcactttttcgtggtttgatattttcctgttttattaatcatttaataaacagcttttgcattcattgattttctctgttgtttttatatgttctgcttattctcttaatatgatccttcattctgctttatttaggttcatttttctcttctttttgtagattcttaaggtggcagtttaaattgttgattcaaaatcacctttcttttataatataagcacttaatgctatactttggctctcagcactgctttagtagcataccacattttttgggtcattcattaattttcttagtcataatttttgcgagtacataacgggtgtatagtttaaaatttaattttagattcaggggatattgagtgacactggggtgtgttgtatgaatgattctatcatccaggtagtgactatagtacaaaataggtagcttttcagcttttcagtgttctagtacaccccggtgtctattgttcccatccttatgtccataagtgcccagtttttagctttcattatatatgagaacatgcaatatttgattttccgttactgcattaattcatttagaaggcctccacctgaatctatgtcatggcaaagaacatgattttattcttttttatggctgtgcagtattccatggtgtacaggtaccagattttcttaatccaacccactgttgatgggcacctaggctgatgtcatgtctttgctattgtgaatagtgctgtgatcaacatacgcatgcatgtgtctttttggtagaataatttattttcctttgggtatatatgtttacagtaatgatactgctgggtccaatgatagttctgttataagatctttgagaaatctccaaactgcataccacagtggctgaactaatttacattctcacgatcattgtaatgtttcctttttccatagcctttccagtatctgttattttttgtgcttttagtaatagttattctgatggatgtgaaatggtatctcaatgtggtttaattaattaattaattattatcatttaacttttattttaggttcggggtacacatgcaggtttgttaaacaggcaaattgcgtgtcatggggattttgtatatagattatttcctcacccaggtaataagcatagtaccctataggtatattttctgatcttttctgatcctctccctcctccaaccttccatcctcaggtaggccctggtgtctattgttccctactatgtgtccatgtatgctcattggttagctctcacttataaatgagaatgtgtggtggtattcaattttctgttcttgcattagttgcttagcataatggcctggggtttcatccatgttgcagcaaaggaaatgatcttgttcttttttatgtctgtttagtactccatggtgtatatgtaccacactttcattattcaatttgtcattgatgggaatttaggttgattgcatatctttgctattgtgaatagtgccgtaatgaatatgtgtgtgcatgtgtctacatggtagaatgatttatattcctttgagtatatacccaatagtggaattgctaggtcgaatggtaattctgttttaagttctttgaaaaattgatgtactgctttccacagtggtgaaactattttagattcccccaacaatgtataagcattccctttactctacaaccttgctagcatttgttatttttttcatttttaataatagccagtcttgctggtatgagatggtatctcattgtggttttgatttacatttctgtgatgattagtgatgctgagtattttttcatatgcttgttggccacacctatgtcttcttttgaaaaatgtctgttcatttcctttgcccactttttaatggggttgtttgttttttacttgcaaatttgcttaagttccttaatgattctggatattagacctttgttggatgcatagtttgcaaatattttcccctattctttgggttgtctgtttactccgttggtagtttcttttgctatggaaaagctctctagtttaattaggttccatttgtcagtttttgtttttattgcaattgcttttgccatcttcatcatgaaacctttgccaggtcctatgtccagaagaatattgcctaggttgtctttcagggtttttacatttaagtttttacatttgggttttacatttaagtctttaatccatcttcagttgatttttgtgtatggtgaagaagaggtccagtttcaatcttctacatgtgactagactgttatcctggcaccatttattgaatagggagtcctttccccattgcttgtttttgttggctttgtctaatcagatggatgtattatgcaggcttagtctggactatctattctgttccaatggtctgtgtgactgtttttgtatcattaccatgctgttttggttactgtagccttgtagtacagtttgaaggcagttaaagtgatccttcagctttggtccttttggttagggttgccttggctattaggtatctcttcaattccatataaattttaaaatagttctttaagttctgtgaagaatgtaattggtagttcaataggagtaacactgaatctgtacattgctttggaatggccattttaacaatattgattcttcctattcatgagcatggaatgcttttctatttgtttgtgtcatctctgatttctttgagcagtgttttgtaattctcattgtagagatctctcacctctgtggttagctatattccaaagcattttattcttttcatgtcagttatgaatgggattgcgtttttgatttggctctgtttggatgttattggtgtgttgggatagtactgatttttctacatcgaatttgtctcctgaaactttgctgaagttattttttcagaacaagaagctttggcgaaaagactatggggtcttatagatatagcatcatgacatctccaaatagagatagtttgacttcttctcttgttatttggataacttttctttctttcttctgcctgattgctctggctaggaattccagtactatgttgaacacgggtggttagagtgatcatccttgccttgtgtaggttttcatggggaatacttccaacttttgcatattcagtatgatgttggatgtggatttgtcatcgatggctctaattttgatgtatgtttcttcaatgcatagtttgttgagagtttttaacatgaacctgtgatgtttattaatgataagcatttgttcaaatggttgttggctgcttgtatgtcttcctttgaaaagtgtctgtttatgtcctttgcccatttataaatgtggttgtttattctcattgatttaagtttcagattagggatattaaacctttattgaatgcatagtttgcaaatatttgcttctattctgtgcattggctgtttactttctttatagtttgttttgctgtgcaaaagctttcatttaattaggtcctacttgtcaatttttgtttttcttgaaattgcttttgaggatttagtcataaattctttgccaatggtgatatgcagaatggtatttcctaggttttcttctaggatttttatagtttgaggtcttaaatttaaatctttaattcatcatgagttaggttttgtatatggtaaaaggtagggatctagtttcattcttctgagtatggatagacagttatcccagcaccatttattaaataggtagtcattttcctgttgtttatttttgttgactttgttgaaagtcagatcattgtaggggtgcagccttttttctaggcagtctattctttccattggtctctgtgctgtttttatgccagtaccatgctgtttcaatcatcatagccttatagtatagattgaatctgataacatgatgcctttggcttttttcccccttaggactgctttgtatattcaggctcctattgggttcaatatgaattttagaatagatttttctaattctgcaaaaagtgacattggtagctttataggaagaacattaaatctgtcgattgcttttggcagtatggccattttaacgatattaattcttccaatccatgagcatggaatattttccatttgtttctgtcatctctgatttctttcagcagtttttaaacattttctcctcatagagaaatttcatctccttggttagctctattcctaggtattctattgtttgtggttattgtgaatgggactgtgttcttgatttggctctcagcttggaagttattggggtgcagaaatgctactgggttttctaaatggattttgaatcctaaacctttcctgcagtcatttatcagatctaggagccttttggtggagtctctggggtttcctaggtattgaattgttttgtcagcaaagagttattttgacttcctctcttcctattaggatgattttatgtttctttctcttgcatgattgccgtggctaggactttcagtactatgttgagtaggagtgctgagagcttgcatcctcatgttgttccccttcttagaggaaatgtttacagcttttacccattcagcatgatgttggctgtggatttgtcatagatgctttttattattttaagttatgattcttcaatgccttgttcgttgagagtatttatcatgaagagatgttggattttattgaaagtttttgtctttctattgaagtgatcgtatggtttttgtctttaattatgcttgtgttcatttggattttctcttctcattctttgttaatctaactattgatctattgatcttatttattgttttgaagaaccaacttttggttttttgaatacaactctgtatgaatttttgggtctcgattttattcaattctgctctgattttagttatttcttttcttctgctatatttagagttagtttttttctagcgaatggaaaatattacctcactctattttttaaaaaaatcatattatttattttttagatacattttaagtttatagaaatggaatggaatgaatggaaactatagtgactttttatatgtccctcttcatttacacactattttccttttattaaattgtgttagtgtagcgcatttggcataagtgttggaccaataacgatacattattaaataaagtctataatttatgtaagagtccattgtatgtgttgtagagttctatagttttcacaaatgtataatatcatgtatttattattataatattacagagaatagtttgacttcacctattcacctctctctcacttcccctgaatgcctgataaccactgatctttgtcttgtttctatagttttgccttttctggagtgttatctattggagttttacagtatgtagcattttagcctgcgttctttcacttagcaatatgcacttaaggtctctccatgtcttttcacatcttatacctcatttcttttcattgttgaataacattccatttattggttttaccgcagtatgtttatacattcacttttttaaaggtgggaaattggttaagtgttggagtattgaaagatcaaagagagaacacttaggaaacacagataataaataactaaagcaagcagttaccaccgctaaggctgggggaacaaagagaaagagttggcttgtagaaatttagtccccattatactgggactcagacctctgaggagggatcactgtctcaccgctgctagtaccttggaagaggctcagtgacactgtttaggaatataagaaagaagctgaagattgaaattaactgcgctgctaaggtaaagggccattgctgaggcaatttgagaacaggaagcaaagcaaaaaagagtatgtcagttcttcctcccccagccttccagtctcttctagtacctttatggaggaagaactttacaggaagccttcttttcaaaggaacaatgaaatctaataagtcctggccccatcatcacaaagcagagctcagaggagtgggtttgttacagagagaatattgtttagtaactggtacattcacttattgaaggacatcttagttgcttccaagttttagtaattatcaatgaagctgctgtatatatttttatggaggtatatatgtggctatacattttcagctaatttgggtaactacaaagaagcacaactgcttgatcatatggcaagagtatgtctagttttgtatgaaactaataatttgctttccgatgtttctatcattttgcgttctcactagctgtgaatatgaattctggttgctgcacaaacttgccagcattttgtggtgtttgtgttttggattttagccattctaataggtatatagataaataggtatctcgcagttttatttatttatttatttttaaattttattattattatactttaagttttagggtacatgtgcacaacgtgcaggtttgttacatatgtatacatgtgccatgttggtgtgctgcacccattaactcgtcatttagcatcaggtatatctcctaatgctatccctcccccttcccccttccccgcaccctacaacagtccccggtgtgtgatgttccccttcctgtgtccatgtgttctcattgttcaattcccacctatgagtgagaacatgtggtatttggttttttgtccttgtgatagtttgctgagaatgatggtttccagcttcatccatgtcctttgtaggacatgtgaactcgtcattttttatggctgcatagtataccatggtgtatatgtgccacattttcttaatccagtctatcattgttggatatttgggttggttccaagtctttgctattgtgaatagtgccgcaataaacatatgtgtgtatgtgtctttatagcagcacgatttataatcctttgggtatacacccagtaatgggatggctgggtcaaatggtatttccagttctagatccctgaggaatcgccacactgacttccacaatggttgaactagtttacagtcccaccaacattacaattttttaataacataggatgttgggcatttttcatatggttatttgtcatctgtgtatcttctttaattaggtgtctactcagttctttggctattttttttttttttgagaaggagtcttgctctgtcacccaggctggagtgcagttgcacaatttctgctcactgcaacctccgcctcctgggttcaagcaattcttctgcctcagcctcccgagtagctgggactacaggcgtgcaactctacacctggctgatttttgtatttttagtagagatggagtttcaccatattggccaggctggtgtcgaactcctgacctcatgattcacccgcctcagcctcccaaagtgctgggattataggcgtgaaccaccgctcccggcttctttggctaaatttttaatttgattgtttattttcttattgttgagagttatatattctttgtatattttagaataaaccctatatcatatatgtgttttgtaagattcgtttctggcctgtggcttgtctttccattcttgtaataacctttttggcagagcaaaagttctaaatttccaaaatttttaaagttctaaactatgatttttttttattttatcgattgtgcttatggtgttatatctaaaaagtcttcatcaaacccaaggtatattagattttttcctatgttattttctaggagttttataattttgtgttttatattcaggtctagaatccattcttaattaaattgttgtaaatggtgtaagatctgtatctagattcatttttctttttgcatgtggatatccagtatcatttgttaaaaagattatgatttctccatgacttgcctttgcagtttgtcaaagttgactatatttgtgtgggtctatttctgggctctctagtctgtttcattgatgtttttgtttattctttcactgttacccactattaccacactgtcttgattactataaatttatagtaagtcttggaataaggtggtatcagtcctctgactttgcttttttctttcagtattgtggtggccattccagatcttttgcattttcatataaacgttagaatgagtttaccaatttcacaaactaattttctgggattttgattgggattgtgttgaatgtatacatcaagttatgtagaactgatatcttaattatattaattgcttacatccatgaatgtagaatatgcttgtatttatttaggtctacatggatttctgttattagagttttgtagtttttctcctatatttcttataaatactttgttagatttatatctagttatttcatttttggtgcggatgtaaaggaaggtttgttttcaagttcaaattttaattgtgcattgctggtatagaggaaagcagttgagttggatatgtaaccatgtatcctgcaaacttgctgtaattgcttattagttcaaagagttattttatttgggatcagctgtatacacaatcatgtcatctacaaacaaagccagttttattttcttcttttcaatatgtatatcctgtattttcttttcttttcctattatgttggcttggactttcagtatgatgttgatgataaatggtgagaggggatatccttgatattttcttgaccttagcagagaaacatttagtttctgaccattaagtataatataaaattagctgtaggatttctgtggatgttctttatcaagttgaatagatttttctctatttctgtcttgttgagagtttttaaggtgaatgaatgttttattttgtaaactggtttttcgcatctattaattttatcatattatttttattctttattctcttgatataactgattaattgaattttgtatgttaatccaaccttgcacacttgaagtaaaccctatttgatcatgatgtaattctttcatatatatatttttttattttattttattttattttattttattttattttattttttgagacagtgtctcactctgtcacccagggtggagtgcagtggcaggattttggctcactgcaacctccaccttctgggttcaagcgattctcctgcctcagcctcccgagtagctgggattacaggctccctaaatcatgcttggctaagttttgtactttttgtagagatggggtttcaccatgttgaccaggctgatctcgaactcctgacctcaagtcatctgcccgcctcagcctcccaaatttctgggattacaggcatgagtcactgtgcctggacaatatattgttgaattttagtggctggcatttttgagaacattttcatctatgtttttcagtaatattgatctgcagttttaatttcttgtaatatttttatctgtttttttattagggtatcactggcctcatagaattagtgaggaagtattccatttgcttatattttctggaaaagattatggagaactggtataacttcttccttaaatgtttggtagaattcaccagtacacccatcgtagcctggttattattcttttagaaaattattaataattgattcaatttctttaataaatatgatcctcatcagattgttcatttcttcttgtgtgaattttggtaattgactctttcaaggaattggtctgcttcacctatgttatcaaatttgtgggcccacagttgtttataatattcctttattattttaaaattgtttttaggaacagtaatgataactgtcttctcattttttatattagtaatttatgtgatacctcttttgttttcttagttatcttgtttagaggtttactggttttattgatttttttcagagaatcaagttttagtttcagtgatttcatgttatcaatcacattgatttttgcagtaatttttactattacttttttctgcttattttgttttaatatgatcttcttctttacagtttccaaaggcagaagcatggataacctattttctaatatatacatgctgatctacaagtttctctgtcagcactgcatcattgcatctaataaattttgataagttgtatttttattttcatttcattcaaaacacttttaatttatcttgaaactttttttttccataaacgtgttatgtagaaatgtgctgtttaatctctacatattggggttttccaggtattttttgttattgatttctagtttaatgtcatcagagcctgggagcattttatagcttagattctggtcagtcttggtaaataatccatgtaagtttataaagaatgtgtattttgctgttattggatgaaaaatatataaatatcaagtagagccagttgactgatggtcttattcagtttaattctgtcctaagatattttctgtcggccaggtctgtgaattactgatagatggctgctgaaatgtacaactataacaatgggttcatttttttacccttgaaattttatcagttttgcctcatgtatcttgtgctgtgttgttaggcacattcaccttcagaattgttatgttttcatagcaaattgactcctttatcattttttaattcccttctttatctctgtaaattttttggttctgaaagtttcatttatctgaaattgatatagctactccagcttgttttcttcttcaattatatattttttaatttttagagtcaggatctcactctgttatcccagctgcagtgcagtggcatgatcatagctcactgcaacctcaatattttttggctcaagcgatcctcccaaatagcttggactacagttgtgcatcatcctgtctggataattttagtttttaaaattttttgtggagactgagtcttgctattttgctcaagctgttctcaaacttttggcctcaagtgatcctcccacctcaggatctcaaagtgctgagatgataggagtgagccaccatgcctggctaagctacttcagctttctttagattagtgctagcatgatatataattctctacctttttacttttaatctatttctgtctttaagtttaaagttgatttcttgtaaaaaagcaagagttgggcagtcttttcttaaatccactgtgacagtgtctgtctttttatttgggtatttaagtcattgacttttaaagtgattattgatatagttggttaatatcttccatgtttgtaactatttttattcattgccctttgtctttctttctatatgtgtttcctattccttttctgcattttctggttgtaattgagctatagttatatatatagttttacatatatatagttatatatagttttatatatatatagttttacatatattcaatttacaaagttacagtattgtacaactctcactaatatgtagtttcagaactttttcaagacctgaaagtgaaaccccatactcattaaagttatttgctattactccctagtccctgcctgttgttaccaccaatctgctttctgtctctaaattctggatatttatctattctgaatatttcatttcatgtaaatgtattcatacaatatatggccttctgtacttggcatctttcatataacataatgttttcaagtctcatccatgttgcagcaagtattagttcccattcttttctatggctgaataatattccgttatacagatatattacaattttttaatccatttatcagttgatggacatttgctgctataaacatttttgtacaatttttattttaatacctgttttcaattcttttgagtatttacgtaagagtagaaattttgggtcatatggtaatctcgtgtctaacttttttaggaactaccaaactgttttacacagtaattgcatcattgtacattcttaccagcaatgtatatgaattttaatttctccacgtcttttcaaacgcgtattttctgattttttcattatgacccccactgtgcatatttcattgtggttttgatttactttttactaatgactaatgatgttgagcatttttcttgttcttattggccatttgtacatgttctttggagaaatgtctattcaaatcctttgtctattacttaattggtttaattatttaattttttgtctttttttaagttattagggttctccacggtttttggatatagatttatcagatacatagttttaaaatattctctcgagttctgtccgttgtctttttaactctcttgatatgtcatctgatgcacaaaatgttttatttttgtgaattccaatttatctatttttccttttgttgcttgtcccctcagtgccatatctaagaaactattgccacatccaaaatcaccaagatgtacccttataatttcttctaaaagttttatagctttagctgtggttatcctagcaccacttgttgaagcaactgtttttttttccccattgagtgtccttatcaatgttgttgaaagtcaattaaccacatatttataggtctattattggattttcatttctctttcattgatctacatgtctatctttacaaaagttctagactgccttgattaatgcagtcttgtagtaagttttgaaattgggaagtttgagtccctgagcactgtttttcttttccaagatgttttgcctattcagggccccttgcaattccatatgaattatatgtttgggtttcctagttctgcaaaaaggcaattgcgatattgattcgaattgcattgagtctgttaattgctgtggtgagcactgacatcttaacaatattgttttccaaatcatgaacacaggatgtctttctgtcttcatttttagtgtagtattttacaactgtaatttctcccttaagcacttctttagctgcattcaatgcattttggtgtttcatgtcttcatttttattaatctcaaactactttctaattttccttgtgatctcatctttcatcctttggttatttagaagtgtgtatttcaatttccttatatttcctaaatttctttttgttattaatttcaaattagttctactgtggtcagaggatatactttgcttgatttaaattctttaaatttattgagatttgttttattgtctagcatgtggtttatcctggagaatgttccatccatatgcacttgagagtaggtttccaatgggttttggtggagcagtctctagatgtcttgtttatctaattgctttacagtattgttcaaactttatatttccttagtgatattttgtctagtttttctatgtgttattgtaagtggaatattgaagtctccgatcattattagaattgtttattttcccttcattccttgaggctttgcatcattactccagggctgtaatttcaggcacatatattgtattagtccgttttcacactgctgataaagatatacccaatactgggcaatttacagaagaaagaggtaatggacttacagtcccacgtggctggggaggcctcgcaatcatggtggaaggtgaaaggcacatttcacatggtggcagacaagagaagggagcctgtgcaaggaagctctccttttaaaaaccatcatatctcgtgagatttattcactatcacgagaacagcatggaaaagacctgcccccatgattcaattacctcccaccaggtccctcccacaacacgggaattcaagatgagatttgggtggggacacagccaaaccatatcatgtatgtttgtaattattacatcttcctgatatagtgaccattataattataaaatgtccctctttattgctggtaacattttaaaaatgtttattttgtctgtccttagaggaggcatccttaggcttaagtatagtcatcatgaaattacaaggttttagcatcgttctctttgactgtcactttcactggtatctgtgttaagccatttgtctgttggtatcacacccagctgttagctctgagttacagtttattattctattgttttgacagtgcattggaacataaatgctgcatagtctgatccaattatattccagtgtctttgcaagggtagttttatagggtagtctttgcggtttttttctaccacaggagagaaattgctctcctttccatgatccttgctggttaacaagctggtctgtggcttagcttttttctctcatggagctaagttgtaacccctttatttctttcctcgtcactgcttacatctaaaatctccattgtatttaagagtacccttaagtttgaacttcccacactgttccaaaaaaaagttagcctccttagggagagcttcttagttttcttttcttttttttttttgtgtttattataatttacgttctagggtacatgtgcacaatgtgcaggtttgttacatatgtatacatgtgccatgttggtgtgctgcacccattaactcgtcatttacactaggtatatctcctaatgctatccctcgcccctcccgccaccccacgacaggccccagtgtgtgatgttccccttcctgtgtccaagtgttctcattgttcaattcccacctatgagtgagaacatgcggtgtttggttttttgtccttgcaatagtttgctgagaatgatggtatccagcttcatccatgtccctacaaaggacatgaactcatcctttttaatggctgcgtagtattccatggtgtatatgtgccacattttatttatcttagttttctattattgtggccaattccttcctttctaggggaaaaacctgcatcactgctctggagttgggggtaaggagggtggctcatttctctcagaatgaaaaaagaaattgcctcttttcttctttctttctctttctttctttttctttcttcctttctcttcctcttcctttctttccctttctttcagaaattgcctcttttcttctttctttttcttttttctttctcttcctctctctttctttcccttccttccttccttcttttctttctttctttctttctttctttctttctttctttctttctttctttcaaagagtctctctctgtcaaccagctggagtgcagtggcacaatcttggctcactgcaaacttcacctccaaagttcaagcgattctcccacctcagcctcctgagtagctaggactacaggtgcacaccaccatacccagctaatatttgtatttttggtagagacgggttttgccatgttaccccggatggtcttgaactcctgacctcaagtgatccacctgcctcagcctcctaaagtgctgggattagagacatgagccaccatgcccagccagaagttgcctctttcattattagcttgcgtatcccagaatggaaccttcaccctttgaatcacatggggcaaggatgatatgggccccattgctcttggcctgcttcacctgtaatagagctactaccatatgacatgtggtttggtggagtgagtgagctccaaagctctcagctgctctggaagagagttttgcaacacaaaactggggatgatgagaaatgagaaatggtttgtgtcttttaggagatattgtaacattcagctgtaaactgggaaaagagggaggcctgtgatttttgtcacatcaattcagagtggagcacctatgttgctgagtggaggtagagagaatttcatggcttttgttgtagacacttgctattctcatcgagatttagcagatattttttaataaatattttttcttttgctatatgcaatttggactatttccagaggctttaagtttttgttctaaaataattctcaccaattatgattttttcccctggggaaatttttccatgaaaacttttgggtttactctgggtctaataattttgaactatatgctgtatattttgagtattataccagtattatttaaagtctaggcagaatattccctgtgcagaatgctgatagtttttctttctcagtgaatgggactattcatgtttaggcaacaatttctcatctatgccgtgtgtattgtgcttacaaggtaattgctgtttttaaagtctgtgcagtgatttttggatctatcctttgtgtacattacctaggccattttggcacttggtcagtggtatatctgttaatttagatattaaagtctttggcaggcacattaacatcagatccctgtgtatgcacagcccaggattgatttcaggatgtcatagccacttttattggctcattgtcctcactgcctccttttttcctaagctctcctgtaccttccagttctttgggtgtcctcttttcagtcttttggccggatgcttgagacttagttaccccactatatcgtgcacttccactcctgtgtgtgcattcaagttcaagtggtgggaagtcagagagcaaaaacaaaacaaaacaaaaaatcaatgtgcttggccccactttctttatgccatagctcctgtggtcagagagggagattcctgtgctcctgtttctacgctagagattacatggaatctaggacataggcaatagacaaggaaagtgaacaccctttgaacagtaggcattcacttttctgctccctgaaccaaaattaaagggggctttctatattcctctctgtaccccagtgcctattcatggtattcggaatgcacttttgaaagtcgtattaatggaaattcatataccccaaacagtttttattcctgaaaattgaggaaattattagatattacagaaaattttccaaagtttctattggggcagatactggttttaaaaaattcaaatattaataaaacaaatatagaaactttcagaattctgtaggaagctgttaaataaaaagtatacttagttacagtaaagaaaaatgctgtcctgatttcaacttttatccattcaataagcatttattgcatactaataattgtaaaaatattgttctagtcaagcattgtacactgaaatagcttttgttgatggaaatgatggccaatgtagtggctaatatggtaaccactagccacaagtggttattaagcacttgaaatgtggcaagtgaaaatgataaactagctaaagactatgatattgtacagtacagttctagacatttttgaaaacacaaatataactgctaatgaggtagtagttatctattgcacattgtattaatattttatgtttgtttatctcattcattataaccatttgatcattatatgtttatagcagaagaaactgtggtctagagaggtaaagtaactttttcaaagtcacaaagttatgaaacagcaaaatttggcttcacagccatgtacgtattatttgagggtcttttattggaaactgcactatttattgacagggatactgcagtacaatttacatacatgaaaattcactatttagagtataccattctatagttattgataaatgaattcagctgtgtaatcatcaccacaaaaataaacataaagaatatttccatcaatcaaaaaagttaattcctgcccctttgtaaatgcttacactcatgaccagcaactactgatctgttttgctatctctataattttgcccattcaagaatgcaatattaacagagatttatgttataaatagcttctttgagtctggattctttataatcatcagtgttgtagcctttgttagtagttggtttctttttatttctgtgtaatgttctgttgtgtggatatagcaccatttgtttactcgccaataagaagatatttttgttgcttatggtttctgccaattgcaaatataccttctataaacatctgtgtacagatatttgtgtgaatatcattgtaagttgtggatgaataccttgagtacgactattgggttatgtggtaagtttatgtttaactttataagaaaatgccaaactgttttcctgagtggctgtataattttgcattcccattggcaatgaatgagtttccaatgaatgattcacatccttgtgagaaattggtaatatcagttttgttggattttaggcattttaacagggatgttgtgctatctaattgtggtagtcatttgcatttcctgaataactaataatgccagaggtatctttatatgtgcttttgtgcgttccttctttggtacatgtctgtcgagatcttttgtcatatcttattgggttaatttttctcattgagtttaactatttcacatacaatttattaatcagatatatccttttcaaatatattttccccatttttgggtcgtctttttattttgtaacagtgccattctaaggaacaaaactttaaatttagatgaagctcaaattaacaagttttaaagatgttgttttttcatattatttaagaaatctttgcctaatccaaggtcacaagattttctcctatgttttccctaaaatatttataattttaggttttactataggtctattgtattaatttgctaaggctctcataactaagtaccacaaacttgttggcgtaaacaacagaaatttattttctcacggttctggatcctggaagtcaaaattcaaggtgtcagctgagttggttccttctgaaggttgtgagtgaatggtctactctatgtttgtttccttggtttgtaagtggccttttctttttcatattgtttttcctctatgtgtgcctgtgtcatattttccgttctttcagggcagcagtgatattggattcgacctcaccctaattacttgatcttaacttgattacctctataaagatcccatctctaaacaaggtcatattttgaggtactgagggttaggatttcaacatttgaattttgcggaggacacagctgaacctataacagtctgccctttgccctcccccagttcatgtccttttcgcatgcaaaatacattcacccccattccaacatccccaaaagtgttcatccattttagcatcaactgtaattccaacatctcataaaaatctcatctaaatcatctatggatgagactatggttatgattcatgttgaggcaaaattcccatctagctatgaacccagacaacaagttatctgactgctttattaattattattaatttttcaactatccagcttttgatttcattgttttttactataaattttatactttcattttcattgaattctcttcatctctgtagcttccactcttgcacttggcttgatatgctattctttctcttgagcttaaagtgaaataattgatttgaagtctttcttcttctcttaagtattctcattaatactagaaattttcctctaaccattgttttactttgttcccttttcatttacaatgatttcagaactaactttctatttgacttcttctttgccatgggttatttagaagtgtggtgtttatttttaaagtgtttggggattatctagatatttttctcttatcagtttctagtttccttaaattacaatcagtcttatatctgtgatttcatttcttttaaaactgaggtttctttagtggctcagaatttggccagttttaaagaaagacaatgtgttcttgaaaaaaagtatattctgctgctactggatggattttctattaataggatttaagtcaattttaaaataatgttgtttagtaattttgtatcatcactgatgttatgtttacttgttctcttgtacatttggattgagtatagataatcattatgttttatctctactaggtagagatatacttagtaaacctctttccaaattattttagtgtttgccctggggtttatattatacatcttacttttatgctgtctattgttaaataatgttgtactccttcatgtataatgtaagaatcttacaagaatatatttttaattcctctctttgatgctctgctatattactttgtcacattatgttcttgaatatgctataaatctgaataaattgtgagcattttgatttagatcatagattattttgagtgtttgcatattagaagacatgtattttatatttgccttgtatagtaggcaaaattctaaagatttcccccatgcttcccatctcccaatgatttaaacacttatctatttcctctgttggagggattcgatgatgtaattaaaatgacttaccagctgatcttaaaataggaagattatcttggatcatctaggtagccccaatgtaatcacatgagtccttaaaagcatatgaggaaggcagaagtgtcagtcagagggatgtagtgaaagaggaaagtgaaagtggtgactcagaaggggaagtcagagctattacatgtatgagaaagatatggatatgttgttattggttctgagatgtaggagcccgtctgtgaggactcagaaaaagcctttaagagctaaatcctatcactggctcacaaccagacaaaaggatggaatctcagtcctataggtgataaaaacctaattcatataataacctgactgaccttataaatggattcttcccctgaaccttgagtaaggctcttctgatgcaatgattctagtgagtcctgtgttagactgctggcctacagaaactgtgaaacagtaatttgatttgaatcaagcagtttagtctgttccaatttgttacatcagcaatatcaaattattggactttcattttagttatttctgtttcttttcatttctttgtttacatgcaaactcctgtctggtatcatattgtttctatctgaaacccccctttaaaaaaacatttcttttagtgctggtctgctggtactttgttctcttagcttttgttcatgtgtaacaaattctttattttgccttttttctgaaatgcatatatttatgggtatggaattctgagttggcacatttttttttctttaacttctataaagatgtcacccatttcttttcatttgcatagtttcctataaaaagtctgatttaaaaaaaatctttgttcttttatacgtaatataacttttagcctcttgttttcttcaataatttgttttagtcttcattttgtaagcatttggccattttctcttcaaataatttttggccattttcttttaaaaaattttttcagccctttttgctctctcttgtttttcttattccaattatgcatatgttaagccttttgatattttctcacagttcttggatgctttttctcacagttcttggatgctttttttttccttttttcaatctttttttgtcttttttactcaatttggtgtttttattaatctacttcaagttcactgtttcttgtttgtattgagtctgttgatgtcacaggcattcattttttctttgtctttttaaaaaactattgttttaattttatactttcttttagtttacatctctgcttaaattctcctttgttcatgctgttttttaccttttccaatagaatctatagtatattaactatggtccccatgtgatacttttgattttgacattatctctgaatctggttctattgttttgtttcttggcaatggtttgttttccttgctttactgtgtgtcttataatgttttattgaatggtaatcacgtcttgtagaatagaagaaacttaaggggactatatttgtgtcttaaactgggcatgcttcttctgctctaatctttattatatcttttttctagtaattttgggttttgcttactcttgcttttctagttttttatgagacatgagacattgttagattttttatttgaagtttttttttttgatgtaagtacttatagctgtaaacttccctcttagtattgccttttctgtattccatagtttttggtatgctgtgtttccattatcatttgtttcaagaaattttttcaatttttcaattaattttttcattgacccactggtcattcaggagcatattgtttactttccatgtatttgtatagtttctaaaatttctcttgttattgatttctagttttcttttattgtggccagagaagatacttgatattattacatttttttctgagtgctttaaggcttgttttgtgacctaacatgttgtctggtctttccctgagagtgatccatgtgctgagcaaaagaatgtgtattctgctgctgttggctaaaatgttctataagtatagattagatctatttgttctatagtgcagattaaaactgatgtttatttgttgattttctgtctgaaagatctgtccaatgctgaaagtggggtgttaaagtctccagatactattctattggggtttatttctctctttagctccaatagtatttacttttcacacctgggtgttctgttgttggatgcatatatatttaaaattgttatattctcttgctgaattgagccttttatcatcatatagtgacctcgtttgtctatttttatagttcttgtcttgaaatctatttagtgtgatataagtatagcaatgtttgctttttatggtttccattagcatgggatatctttttatttttagtctgtgtgtgtctttatagatgaattgtgtttcttgtaggcagcagatcaatggttcttttctattattatttcaatcactctatgtcttttgattatactgtttagtccattttcatccaacattattattgataagtgaggacttatttctgtcattttgttatttgttttctgagcgttttgatgtcttttcatgcttctttctctttttcctgtgttttgtcactgaaggtaattctctctggcaacatgatttagtttcttactttttatttttgtgtgtttgttgtcatattttttggtttgagtttaccatgaggtacatatatgctatcttataacccattattatgaggtgataacagcttaacaccatttgcataaataaagaaacaaacaactaaaatagaaactaataaaactccacatcttaactttgtttccccagtttttatctttttgttgtttctatttatatcttattgtactgtctgattatcttgaaaagttgttttaggtattgttttttattattattattattatactttaagttttagggtacatgttcacaatgtgcaggttagttacatatgtatacatgtgccatgctggtgcgctgcacccactaactcgtcatctagcattaggtatatctcccagtgctatccctcccccctccccccaccccacaacagtccccagagtgtgatgttccccttcctgtgtccatgtgttctcattgttcaattctcacctataagtgagaatatgcagtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatggacacttctcaaaagaagacatttatgcagccaaaaagcacatgaaaaaatgctcaccatcactggccatcagagaaatgcaaatcaaaaccacaatgagataccatctcacaccagttagaatggcaatcattaaaaagtcaggaaacaacaggtgctggagagcatgtggagaaataggaacacttttacactgttggtgggactgtaaactagttcaaccattgtggaattcagtgtggcgattcctcagggatctagaactagaaataccatttgacccagccatcccattactaggtattgtttttgattggttcattgtttagtctttctacttaggataagagtagttgacataccacagttaacagtgttattacagtctgtgtttttctgtgtacttattattaccagttagttgtgtaccttcaggttattacttattgctccttaatatctattttctttctgattgaaatatgccctttaacatttcttgtagaacacgtctggtgtggatgaaatccctcaggttttgtttgtctcggatagtcattatttctccttcatgtttaaagaatattttcaccagatatattactccagggaagaagtggggttttttgtttgtttgttttggttttatccttcagcactttaaatatgccatagcattctctcctattctgtaaggtttccactaaaaatttgctgtcaggcatattggagctccatagtatgttgtaggtttcttttcttctgctgcttttaggatcctttctttagccttgttctttggaagtttgattattaaatgccttgtggtagtcttttttgggttaaatctgtttagttttctataatatccttgtgcttggatactgataactttcttttggtttgggaagttctctgttattgtccctttgaataaactttctccttctgtctctttctctacctcctctttaatgccaataactcctagatttgcccttttgaggctattttatagatcctataagcatgtttcattttgtaaactatttttttcttttgtttttctgactgtattttcaagtagcctgatgtcaagctcacagattgttttttcttcttgataattctgcttttaaagactctgatatattcttcattatgccagttgcatttttccactccagaatttttgcttaattatttcaatgcatgtgttaaattatctgataaaattctgaattccttctttgtgttatcttgaatttctttgtgtttcttcaatacaactattttgaattctctgtcagaaagttcatatatcttgatttctcctggattggtctcttgtgccttatttaattcaatttgtgagttaatgttttcctgaattatctttatacttgtcggtgtttgtgtctagttattaaagagttgattatttattattgtcttcatggtttggtcttgtttgtaccttctttcttttttggaaggctttcagatattctaaaggacttgggctttgtgatttaagttctatctgctttaatgggaacctcaagcccagtagtgctgtgtttattatggactcatagagatacctttctgatagttttggacaagatatgggagagttctctggattaccatactgagactcttgttcttttcccttaccttctcccccacaaaatagagtctctttgtctgttctgagccacctattactgggggtggagtgacaaaagcagccctatggccaaccccttaagactgtgctgaatgataactgaagccagcacagcattgtgtctcacccaagacctggtgtaaccacttcctggcttccacccatatttacttaatgacctgggaatttacaatcagcagttggcaaagtcagccgagtctgtgtttttcccttcaaggcaacgaggtcccctaggccttgaggaggttctaagtgccatccagcagctagggactagctagggactagaatctaaaaccttagaagtctatctgatgttctgttctatactgcagcagaccttcccattcttccattcttccctcccatttccaaaggcaaagctgcctcttcctgtggccacagctacctcagccccatgtatatagtactgccagaataatgacagtgtactcttaagacccaaaggtttctttctttctttctttctccttccttccttcctctttctttctccttccttccttccttcctctttctttctttctttctttctttctttctttctttctttctttctttctttcttttctttctttctttctttctttctttctttttctttcgacagggtctcactctgtcacccaggctggagtgcagtggctcaatcttggctcactgcaacctccacctgccaggctcaagccatccttccacctcagcctcctgagtagctgggactacaggttgtgccaccaagtgcagaccaagctcagttaatttttgtgtttttttgtagaaacggagtttcaccatgttgcccaggctggtcttgaactcctgagctcaagcaatctgcccacctcagcctcacaattgctgggattacatgtgtgagccaccatgcctagtcgccaagggttcttaagttagttttggtgaataatacttggcctgggactcattcttcagggaagttgactcccttctggcccagggcaggtccagaaatgctgtccaagggccaagtcctcaaatcaggaaccctaagatcccacttggtgctcccccaccctgtagctaagctggtgactatagttcaagacaaaatttcctttacttttccctctgcttttctcaatctgaaggagtctctcagtgtagtcaccacagctcgcaatatgttgggtctcacctgaagccagcacactacagagtctcacccaaggccctcagtgtactaccttggtatcactgctggttattcagggcccaaggtctctttattcagcaggtgatgggttctgttaggtttgagctcttgcctttaaggaaattggtttccttttggctcaggatatgtctagaaacgttttttgggaggtagggcatggaatggttgcctcacaaccctaacctgtgttctgttctacagtggctgagcatgtatccaagatgccagacaaagtcctttttactcttcttcctttctcaagcaggagcaagggatctcttttggagctgcaagctgtgccacctggggttgggagagaggtggcacaatccctcccttatccacctgggctgttgtctcagtgggttacatgccccttaagtccactggctttgagcccagctctgcactaggacttgcttaaggattgcagttcttgtggcctaggcttcctttcaagtttgtttagggcctcagataattgtagtccatgatcatgaagcttgccataattaaagatctgactgatgggaagggagatttccctctggctagggttggtctaaattctccctctgtaggcaggcatcagttgcattcagcccggttttccttaccgctgtgacagggcagcactaaattcaatgccaagtctcacaatctccatgctgtttctctcccaagcccacagactctctgtctacaccacagtgctgctatcacaggatggggcaacggtggtgtcagtgattaaaaactgtctttcttaccctcttcagtgcctctttcagtgatgtgacattaaaaccaggtactctgaattctcaccttatttttggttcttattaatgtgcttcttttgtgaagacagttgttgaagttgttgttcctgtgtgtgtgtgtgtgtgtgtgtgtgtgggtagggggatgataggtggatccttatattcagccatcttgcccagccccctctctaaaaggttttttttagtcaacaggtgatgaatactgccaggacagagtccttcccttcaaggtagtgggttcccttcttgcccgggttgtgtatagaaatgtcatccaggaattagtgcctggaatggggggccttgccactctgtctgggaccctatcctacgtgactgagctgatacacagctctgttgcaagacagattcctttttactcttctctctcctctcttcaagcagaaggatggtactcttggagctgaagctccaccacctggtattggggaaagggtcatgcaagcacttcctcagctggcccacacaggttgtgtacctccctagtccactggctctaagctcagcacagcactaggaactacataagaatttcagtccttgtggcctaaactgccttttgagttcattcagaaccccagagcaatttagcctacagggtcaaggcttaccaatgtcaatttttgaatgttaaaatgggaaattcccttctggctagggctgatctaaatgctctctttgtgggtgttggtgttggcagcactaaactcccataatagctatgctttccctcctgccagcacatagattctctctccacaccaggtggctgctgccaggggatggggcagaggtggggttgacaattcaagactgtctttcctacccactacagtgcctatttcaacatatgaagttaaaactaggtcttgtgattgctcacctgatttttgattcttatgagtgtactttttgtgtagatagttgtcaaatttggtgttcctacagggaagacaattgttggagacttccattgagtcatcttgccccacctcatgacctagttttaaaagccagatcatatttaacctattgttctaggacttgaaataggcttttaaagttacagaatacttactatcaggaaatttatcttttaaactgattgaaatttgttttgccatgttgtttttctggctaaatatctaggttttcctatccaaagtcaaatgcatgttaacatgaataaatagcagcttatagtttattatataaaatatttctgctttgcaagttctttaatccttaatatagatattttgtgcaactctcccacctataattatcagctttgtacttttagtagttttctgtttaaaaaaatctatagtttatttttggttaaaaaatatatctgtgtctcttagatggaaggtcttcagagttttttcaactttctagttcctgtcagtgattgtgtttctctaactcttacctttctttttccttttcatctgcatatctcttatgtttacctttactccgtgctgactagtgctcctggcacctttctatttcaatgcttatattaaaaaaaactttattccttataacattcctctttaaattactattctgttactatagactataaaaccaattataaatttttttggttaatgaaaaaatatgggcaatgacttcccaatggtgtataccataagctgctcagtggttaacttcttggttttgagaaaataaatcatcttcagttcttcgttttgcctaccttggcagaacctcataattaaaaaatttgtttaattttggggttatctaggttctggtgtttcctgagaataaggtactatcattgatgccttcttgccagatagtatgatctcttgatttttcttataaaacataatatataagcatacatatcaataattcaggatctatggcataagtcagtcacatggtctgttctagaagatggagtagctccttctactttcatacttaagatctaatttataaaatattattcagcatatttctatgtaactctcatgtacttcataaaggaaaagtacagaatatactctttggtataaattaatgtagagcctttttgacaaacttattaccatgcacatattcaaatattaaaagtgaactaactgtgttaaatagttgagcaccttactcaaaggtaaactacatcacagtaacgtcatcattttcttaaataaatctgttttcaagtgagatacctgatctactgaagaaaacattttctttattgatttttatacaggcaccttgacaaaatgactatattatctagacggataagtgagtattcattacttttgaactataattatgtcaagattcattatcttaggtggaacttgatagtgtttaggaaatcttatattctgcctccaaaaagcaagcttgttaatggggagtagaatttatttgtaataatatactcagatttgtagaggattattaaaatgatcttgaagaaatagaaaaaattaagaaaaatataatattgtgaccatttaaaaggtcttgagaaaaataactctcttggatatgtctaatgtttgtgaaagtattcttcatatctcttgtaataaatctgaagaggagatgttatcccattttgcaggtgaggaaatcaaagtttagagtttcccatttgtcccttgatattctgttcagtatctttttttaccaccttcacaacagattttttagtttgatgacaatttaattttatctaatttgacaatggagagctggccactgctatttatgtaacagcagagggatcaggtagtgttgttgaaagtcctacaaattctgctttccataaaattttgaggggaatacagctcaagatagcagtgctcatcagcaaaatgagttaattcatactctcatttaaggtgagctgtacctagcagggtaatcccaaaaggcattttaggatggttgaatgtaaataaggaaaaattatagaagattttctctatgtttttgatacaaaatctcggccatcatttggcaaagaatagcaaggtttcttgaatttgtctattccttacaattctgtatctttttttctatacaaagccttctttgtgaggaaacaaagtgaataggtccataaaatgttagatcaccttgaaatcttctaaaacactctatcagtgactgttgtcacccactcttattagtcttttctggaaaagatcttaagacaaatcagactaagagaatctcttcatctgaagaaagagaagctctgttgctatcagaatgtggatttgagtttcatgaaggaattcaacttttcccctttgaaatgacatttcaagcatttctgggatgaaattagcagatgcaaacctattatgggtccaactaccttgtcttcatgttgtttaattattatgacaacactgtgaatgaatattgttgctcccattttacataggcgagaactaaagttctgacagataaagtgactttgtcaaagtaggtgatagagctgaaacttgaaatcagatttatatgtctccagatcaccttggtctggtggcagaactggacttcatagttcacgactaataatactaataatactctgtcatatttttgactgctcagtgtatttatgttttattttcctgagctgccttactcagcacagtaaccccacaatttgtaaagtatagtaattgactttgttttataagtgagaaccctgaagatttgcacaagattatacatccaaggagtaactaaagcactattttaatgtaaatctttctctcccctcatcctgtaaccggtattatataccacatggaccttatagagtgacagcagccatttaactgcctactgatttattttattttattttatttcaggttcaggggtacatgtgcagttttgttatataggtaaacttgtgtcctgggggttagttgtacagattatttcatcacccaggtactaagcatagtatccaataattattttttttctgatcctctccctcctcccacactctaccctcaactaggccacagtgtctgttgtctccctcattgtgtccatgagttctcatcatttagctcccatttataagtgagaatatatggtattcgttctgtttctacattagtttgctaaggataatggcctccagctccatccatgttccccaaaacacatgatctcattcttgtttatagctgcataatattccatggtgtatctgaaccatatttttttaattcaatctgtcattgatggacatttaggtttattccatgtctttgttattgtgaataatgctgtaatgaacattcacatgcatgtgtcttcatagtagaaagatttatattcctttgggcatgtacccagtactgggattgctgggtcaaactgcagttctgttttcagatctttgaggaatcgccacattgttttccgtaatgatttaactacttcacactcccatctacagtgtataagctttcccttttctccacaagctcaccaacatctgttattctttgacttgttatagccattctgactggtgtaaggttgtatctcattgggattttgatttgcatttctttaatgatgagtgatactgagcattttttcatatgcctcttggctgatgtatgtcttcttttgaagtgtctgctcatgtcctttgcccactttttaatggggttgcttgctttttacttgtaaatttctttaagttccttatagatgctacatattaaaactttgtcagatgtataatttgtatttttttctcattctataggatgcctgtttactctgttggtagtttctttcactgtgtagaaaatattaagtttaattacatttcatttgtcaagttttgcttttgtggcaatcgcttttggtgtctttgtcatgtaatctttgcctatttctatgtccacaatggtattgcctaggttgtcctcttcggtttttatagtttttggttttacatttaattctttaactgaccttggagttgatttctgtatatggtgtgagaaaggtgtccaatttcgatcttctgcatttggctagccagttatcgcagcaccaatcattcaatagggagttctttccccattgttttaaactgctttgttgaagatcaaatggttgaaggtgtatgtcattatttctgggctctttattctattccattggtttgtgtgtctattttttgtaccagtaccatgctgttttggttattgtagccctgtagtatagtctgaagttgagtagtatgacacctacaactttgttctttttgcttaggattgccttggctatttaggctcttttttttgttgttgttgttccatacgaattctaaaatagttttttttttctacttctatgaatagtatcattggtagtttgataggaatagcattgagtctgtaaatttctttgggcagtatggccattttaatgatgttgattctttctagctacaagcacgagatgtttttccatttgtttgtgtcttctctgatttattttagcagtgttttgtaattctcatcgttgaactttctcctctctgttcagctgtattcctaggtattttattctttttatgtaactggttactgtttctagagtttattttctgcaaacattggtaacacttctcttttttttacaaatattggtaacatttgtatcaaccttcatgtggtacatgttaagcatgcatatgttgacaaaatattattagaaaaactgctctttctaccatcaaataaaatttcaagtacaagtactataaaatgtgaattatcaatgcagaataagggtttttctgacttttaaatccaattttgagcaatgtaacccgaagtagtctggtttattaaaacattagtttataatgaaagcctttgcattgaattctgttttcaccatcacttagcaaactgaataagctatttaatgtttctttgtttcactttctttacctataaaatgagatagcaacttttagttcttttaagattatgatgagaattgactgaaataatttatattaaagaaactatcagctgagcatactggcttgtgcctgtaatcctgggtagttgggaggctgaggtgggggcattgcttgagacgaggagtttgggaccagcctgggctacacagataaacactatctcatatatttagccagacctggtgctgtgcatctgtggtctcagctatttgggaggctgaagtgggaagattacttgagcccaagagttcgaggctgcagtgagttatgattgtgccactgcactccagcctgggtcaagaccccatctcaattaattttcaaaaacaaaagtatcatattgccagatatagtttatgagctcaatgaatattattttggtgattcagtgcaaaatatactataatatgtttgtttatcatgaataaaagaatggaaagagtcacaattttataaaaagctttctatgtttgttgtttttgcttataatctttgttatcatagcaatataaaatagataaatgtatcatacatagtaggtgttcataatatagacttatcgacataatctaagcctagagtgtactactttgtagaaattttttgataattaaatgatacatgtacaaatatgttttacataaaatgtgaatctatacatagatgtaaactattattaattgtttagttatcgtaatattgttttaaataaccaaatagatatatgtgataatttgcaaatttaaaagacagtgttttgagttacagacttttcatgagtagttttatctttttatgctttacattagatttcctacaattgccttatttttttctaactctcaattctactgtggttacttaaaaatgcactcagttttaaaatagaaagttttgagaatttggggaaggaagaagaatttatacttgcttatttatataaactacattggctaccacactagaattggctcttaccatgacttaggttcagttcttgctttttaaacaccatagtcttgctttttaaacacaaaatctcatgtattttctcccatatagtccagctattcatatcaacttgcaattttctgtgaaaatacacttgttagtctaaaatgaattttgccaattggaattttttaacaatgtttgcacagaaatttaatcatcaattatagccaagatcctataattatttttgtaaataagagagaagatgaaatattcaaatgcctgtttgagtaggtcttcccacaaccctaccacataaaggcacaaaataactctatgtaaaaattacctttgaaaaagccatgtctactgtagttgaatatctatggtttagacttgggcagctgccctatgtaatattttatcttctttattttcttctttcttgcaactaaaaaaacctttaacccagtattcctgaagccagaaaaaacaaatcaaggctaatattctcatgtgaattttttaatgacataagtagggacaagagcggatatagcagaaatgattttaatgtagtgtaacatataccaatttattgaccccaagatttttctatttataaggaagtaactattctgaaaattgtcctatgaactctgtggcattaacaatgaactcttgagatttcttcaagccatagatcttgactgacagtgctattaaataaaccatggtccttagaattacagatactgcataatactgacctatcatctttttcccacgcaaactgtgcaagtgaattgctgaatgaacaggaaggggcactatcagttgttcttggggcagataatatggcatttcatctagttactgtaccatgaaatgttgcattacaatcactctgataatttaatgacatttaagaaatgaaaatgcttagagttgtgctatataggcaaacattaaatgcttacactacaaagccattatacacgaagagactacaatgcagttgttaggtagatgccaatttttcctgggaaaaaaattacagcaaacttaaaatatgtttctttttaattcagtgacttctctacctagattgcaaactttaaattaaccctgattgagatgggaaacctagccatgactgtttgaaggatgccttttcaaacttattctattacaaatatccacagtattatttaaagtggctaacttttattttatttaggccttaagttactgaaatactttgttactgttggtagtaaaggcaaggtggttccagtgaactgttaactagtcctttatggccataacttttaaagtggagaagttagttgccttaaagttgtacatagaaaaaggccgtgaactaggatggtatcttctctttatatcaggtaacaaactgctgaggctctcagttgtgcttagttccccatcactttaggactagagtcggggaattggttttgaaacatggggaatattttttccttttccgtggttatcacggacagcagctttccctggctttctcacactgacactcatgaagaaaagcatgagagacgataactgctaaaatatcctcagtattcccctaacatattggtccattttctctctgaaactggaatgccaaacatattgtaaatcctctgagtctcaaacatattttaatctgagccttctatccttaggacatataaattttgatttattccagagaacagtaacatagttcttttattagtttctccattgtgccttttgtttgtgattgagagactgtggaagggctgagagctggggactgagtagtgggagcagtgcaggaggggaataaatgccactaaataatcttttgacaagcaaataaaacaaaaaaaaaaaaggagagaaagaggatatattaatctaccccgtgtttttcaaagacaagtagattcgagaggatctctgcttctgggaagttctctgttttcagtatagagagtccttaatctttgtgattgacatccctctttttagaagctagtgtgacataagaattatgggtctgtcttttaatacagttgaaatatttaaaatatgttaagaaaagactactacttttaataattcctttgggctttttccattttcttctaaaaacatttattaatctattaatttggaaactccagtttctcattaggatcactgagctttgtggtgatcatttgtatttaaaaatacattgagtaaagtcttttgataatatatgagaaggtgtcttctagaaagctctagttctaatttttttcaaatcattacaagatgtagatacttagagacagcttgcacctgcaaagaaaagtggcacagtgagacagttattaggatcattgaagaaataagacacaataccctaaactttcacagtggtaatttgtaaacattagacaaaacataatttggggaggcatgaattatccagacaagtgcttgataaattaagtggtataactcttcccctatatctcagtccctcatactggattatataagcctaactaatttattgctctagttttgataatgatttaattcatggaactataaaagaacttttttggttccagaattttaataataaaaaaaaaagaagaatagaactttcgagttagattaaagctttgttcaattctctgccttattacttattcaccatgtgatcttgcacatgctagtcagtctctcttgcctttgctttcctcatctgtataattggcataatagttcttgcattttcatagagttgttttgaagatcaaataagatcatgtatttgaagttttgaaacagtgcttgacatacagcagtgggtgtccaataatagttctcattttttctcttacattggctctgtccagtgatgacctaaagtagcaaactgttgttttagttcatggaaaatgtacattcaaaataatgtagcttaaaattaagaaggctctttgccatttacaaatttagtgacttcagtgctgattttctttcaagaacgtttcataggaattagtttttcagctccctttcatatttttggaaaatctagtgtgtatatcatataatagtggtatttatgaatgaaaaaaacttgtttacaactaatactgcaataccagtttagaaaacagggatctgctttactaaactttgctaaatgccaaagtaatacatagctattaaaacctcaagaaaaaaaagacaattcctttcagccacaatatcacctaaaactaaagtattataaaagctaaacaatgccaagtgaattttgctgagatcaaaagtcaaacctatttatttattttatttcattttcagtgtttcttttcctaggactatcaccttagtcaaacatctactagagttagcttttgatctcagccttcttttggggtaaaaaggaagtcaatcttcaatttttttcttctagagacagtcactctattgtgttttaatgttccaatagtgtgtgagtaaataagattctctgacatatgtgatagaagactggttaaatgggacaatcatttttgtgtaagagacaagaatcaaaaggaagcattcttcacaagctattaactgaaaaaaaatcccctcaggtcagtggaaatatgttaaatggtcagtcttctgcctttttaggtcttttgatgaaaatgccttgtaatttgataacagatagttgctcattagtaatataattttctccttaccattcatagttactccatgatcaatcaggagaaaatatttcttttaacctagatattttgcttaaaaactttgtttaaaatgtcttaatatctctagaaaggatcatgcatttttcattcttcttgtcatagattaatcaaactatagggaaattttcatgatatattaaagacacaagagacatgacaacacatgatgattacagttgaattaaaaagaaaaaaaactggtgtttgatggcagtgaaggtatgtttgtgagtactattaacacatgtgtatgactacattctaactattgaagatctttatatcacctttactaaatctattttattaaatggtaaattcattaggcaggtatttatcaagtactgcccacctgggaaagacctctctaggtcatactgtgagtacaaagctgagtaagacatagtcaatgacctatagcagacttcacagcctttctctgagttgagaaaatgagacctatgtgtagacataattataataaaaggcaaaaaacccatatttataagcatacatatgtttgtgtaaatatgtctatgtgatatagggacattcaaagatgagaataattattaacagttgtgggaattaaagaaaatatttggtgttgatggcatttaatttgtgccttaaagattggttaagttgcagttggcaaaacagggataaaagcatttcaggggaaagtggcaatggtctgaacacaagcaaatattaataccaagtttttttgggaaacagagggttcagtctagctagaatagtgggtttgtgatggaaaaaaaaggagctctgtctgaagatgggtggggatagattattggagattgtaactcccatattaaaagttttgaactttattctacaggaagtatcaaaccacaaaacacttttttgtaggtgagcaatgtgaagatactcctctttacaagaatgtcactattaagagaatataacatagactggaaaggcaaagagttagaggcagagagatcactcaggaagttcttcaagtagtctagctgagaaagaatacagacctattaaaaagtggcggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaacaaaacaaaaaaaaaaaaaaaaaaaaaagtggctgtgcagttcatatttctttttatagagtcaataaatctcctttagacttacaatgtataactctgaagtaatgctatttaaacctgctttggaaaataaatgtgtttgaaattactagtagcaggatttcaaactaaaaaataaagtgtactttatctatacattcctatcagttcatgtagaactttctaacattcctatgcttccgattcaattgcaaccaagcagatcatattgcttttttaaaaaatgtgtttatcttacatgaggtacatggcaatttaaaaaaatggcacataaactatactaagattctgtgtttcttaaaagcaaaaagaagagagtaataactggttaagagaaagtataatttgacaaaaagttgaaaggggttcattattaggatcacaaacagaaggaatggtggtatagatcacctggaaattatacctttgactttggaaagctcatgatttatgccaatctgtttgaacaagttaagaagttaccacagtctttcaggaaacacagtcttccaacaatatccaagatctaggaggacaaaatgggaaaaggaagaaatcattgaaatgaaagggagtaaacagaacatagtttagtaaactattatctagggtgatgtttctgttctcattttattggttctgaacatatacggtcatattcatggcaaaaatacccatggaaattctcaaagctacaaaagatggagtgccttttctcatcaccaagatggtatagtgttactagcattgtgctgggccaacccatcctcatctacctcccagctgtgtatgtttgcttatctctagcatagcagttttaaggtcagacatattattacaaaaatgtttcaaattctgactgaaaaaaaaggtaggagaaagataaatttctttatggattctgtttaatttgacccatttgagttagtatgcccgttagcaacctcaagatattggttccaaacagaaaaatggtttgtatctcttttggaatttattgttaataggactgtgacagaattcaggaaaccagaaagaatattctaccttacaaatcattcaactatcccatatctctatacaaaaaccttcttagtgtgtgtgtgtgtgtgtgtgtgtgtgtgtgtgtgtgtgtgtgtgtgtgttaggggtgggtttctctttcctctattaataacctggcataaattatttaatggagaagtatttttctattaaccaagaactaccttgcatatatcagataatgacacttttgagcaggatgagttggtatcagaattttcctttgcacctatttttctactgagccattatgaaatactgtatgtgtgtaattcaaacatgtcatttgagtgtcctaactgatagtaatatgctccacagaaattttaggagaaaattatgcctattgtatattttcttagtgttagaggcaataccctaaaccccactgtattagtctcttctgatgctgttaataaagacatacccaagactggctaatttataaaggaaagaggtttaattgactcacagttccacatggctagggaggcctcaccattatggaagaaggcaaattaggagcaaagtcacctcttacatggcagcaagcaagagagagtttgtgtaggggagctcccctttgtaaaaccatcagatctcgtaagacttattcactatcacgagaacagcatgggaaaaccccaccccattgattcaattacctcccaccaggtcttccccatgacatgtggggattatgggagctacaattcaagatgggatttcagtggggacacagccaaaccatattattccacccctagtccctcccaaatctcatgtcctcacatttcaataccaattatgtctgcccaacagtcccccaaagtcttgactcatttctacattaacttaaaagtccacagtccaaagtctcatctgagacaaggcaagtcccttccacctatgaacctgtaaaatcaaaagcaagttagttacttgctacatacaatggaggtacaggaattgggtaaaacacacattccaaatgggagaaattggccaaatcaaagaggctacaagccttttgcaagtctgaaatccagcagggcaatcaaatcttaaagctcttaaatgatctcctttgacttgatgtttcatatccaggtcatgctgatgcaagaggtgggttcccatgatcttgggcagctccacccctgtggctcacagggtatagccccactcctggctactttcatgggctggtgttgagtgtctgtggcttttccaggcacatggtgcaagctgtcagtggaactactattctggagactggaggacagtggctctctgctcagtgttccactgggcagtgcactggtggggactctgtgtgggggatcccaccccccatttcccttctgcactgccctagtagtacatgttctccatgagagccctgcccctgcagcaagcttctgtctagacatccaggagcttctgtacatcctctgaaatctaggtggaggttcccaaacctcagttcttgacttctgggcacccagaggcttaacatcatgtggaagccacaaaggcttggggcttgcatcttctgaagcaacagcctgagctgtatgttggtcacttttagtcatagctgagatgcagggcaccaagtctgaagagtgcacaaagcaggaaggccctgggccctgcccaggaaaccattttaacctgctaggcctcctggcttgtgatgggaggggctgctgggaagacctctgacatgtcctggagacatttttcccattatcttggtgatttacatttgcctccttcttacttatgcaaatttccgcagctggcttgaatttctctcagaaagtgtttttttctttctatcacatcatcaggctgcaattttgttaaacttttatgctctgcttctcttttgaacataagttccaattccaaacatatccttgtgaatacataaaactgaatgcctttaagagcacccaagtcatatcttgaatgctttgctgcttcaaaatttcttcctccagataccctaaatcatctatttcaacttcaatgttccacagatctgtagggcagtggcaaaatactgccagtttctttgctaaagtatagcaagagtcacctttattctagtttttaataagtttctcatctccatctgagaccgccttagcctaggttttattgtatctatttatatgatatccatcttttcttgtcacataacaattgttcatgttgttgttggttgtttcaggtagcttctagtacaataactatacattccgatagttaatagaaacatagtttttgatatttgtatctcaaaacatgtggatatataattaaatattattgttataataagcttaatttaggtactgtctaaatctcttgtttctggaggttgagaatcagtctcttaaaagtggtagattataagcaattaggattcacatttctttacatattattcaaatgcaaacctctgaaatgtgattacaagtctattcatacatttatatcaatacatctatatttaattttatgtactcattaaattgagaatgacaagttctgtcacaaagttttcacataattgtgttcactatatcatattgctttgctttctaaaacagatgcttgatgtatttggcttcagtaaatataagcataaactgatgataaagaatgaaaccatcagacagtcaaagagtaaaacaaaggcaaacactttcagtgtttgagtgaaccatctttgtccctgtgcacttctcacttttgttgttatgtcttaacaggatagtcaggcagaatgtgattgtgaagagaacgtaaagtagaccgcttctagagaagcatacttacctaccagcattgggctaatagccctttttcctcctcctgctgttgtcccttctgaacatgcattttgttattctgcagtcatttcctgggcatcaccatggactcactactgtgtcaggcaacagggaatacaaaagataagaataatacatttctagtttatggtagtaagcaccttacagccttggtaagggtgacatttttaacatataaaattaataaatgattagttcattttggttattttggaagtatttcattccacttagattctctgaagtttagcagtggattgaacctcattttaaagacatgaacattgattcttaagataaagtgactcagataggcatacaggtagctatagataaatgcagttttaatatccagactttatgattcctcagtcagtattctttacatcataattcgggctagacaaacactatcctcgctgttttctcaggtctttcttgatgttatgaattacacgtttaattatcataaatatgttgcaagcaacattaaaaatgcagctttttagaccaattaacatttctggatgtattgctggattctttgtccttcatttaagtagtatacacatatttaaaacacaaaatatcacaatgttgaataaaaacaacaaagaatcatagtagttgctctctgcagcaacagagcatgacactggttgagaatcactattctgaagagtggagaattgattgcactgttgattatctggcatttatgtggtatatccaagggaagactggctactgaaaagccacaagagaagtgatctttaggaagccaattacctttctggaaagtggttcattattgagatttaatattctcctactggcagtttgatatcttttaacaagtacaaaacacatttgaattttcattagctgctacacagaagttagcactacaatttaattttagactaaaatatattattgaatttgaggttaatttcccatttattctacttatagagagaaatttattgtactgtattttgccaagtattgctggttttctacacagacagaactgcctttctaaaaaacaggactatgtgttgctgctagttttcttgcgttcccagcatttcaggtagtcttcctgcatttctgggctaactaggcatggaaagagtcactcttggcccaatgtcagaaattaggagtgttttgtcgcctctagtccatatctaatgcacactctctcctagagtcacaatggtatttgctggtcataccacttctggtattctgatttagatatcatagtcctgtggcaagtcagggctggaaattccttaaaaatgatcttgaaacatccagtaatactctataaaaatgctcaaataagtcaccctagggcagagtgcaacttactggaatttgtatatagtattaataattcttatggctcaaattttcttaaacaagaagattgtctattcagtggtaccagaaagacaattaataattctcttaattataatgtataaaaagaggaaacatttaaaatttaaaatatcaccagtgggctgggttcggtggctcatgcctctaatcttagcactttgggaaactgaggtggttggatcacttgagctcagaagttcaagaccagcctgagcaatatggtgaaaccctatctctgcagaataaaaaaaaaaaaattagccaggcttagtgtcacatgcctgtagtctcaggaggctgaggtgggaggatccattgagtctggggtggttgaggttgaactgtgattgtgccactgcactccagcctgagcaacagagcgagaccctgtctcaaaaataataataataatgataaatgataaaaataaattaccaacagacaagtataactcatgattacccaatgagagaacagatgaactttatataaattttaagaaatcctgatatcaatatacagcttaaattcaaattcagaaaataatagtatccaggcagatgaagttgagcttatatcctttgttaaaagaaatagatttagtgcagcatttctcaaactgtgttctacagagttttagtatctttagctcaaataataggtattccattttatgcctcttttggaaattcattaaaatattacatgtgtaaagctttgaaaaaactgccattaaaaaaacctggagtacctgggtttaaaccccaatttcaagatttattagctgtatgacattagacaagttattcagtttctgtcttggtttaccgatctgagaaatggaaatagtaatgttattaccctcttaaggttgctttgaattatatatatatatatacacacatacatatacacatatatatacacatatatatatacacacatatatatatatgaacgagagagagcttgtggcatatgataagtgctaggtaaggtttttattaactcattgttacctaatttggcctgggaagtttctcacccaatttctccatttttaaatagatgctcttttaacattttgtggaacaagtagtcaaatgaaaagtagtttggaaaaagttgatataagacaggttctgtatagtgcttctcttttgcttttaatcttttaacaatagatgtaataggagtgtctgaagagcttattaaactttttttttttttaactgagtcttgctctgtcgcccaggctggagtgcagtggcgtgatctcagctcactgcaacttccgcctcctgggtttaagcgattctcctgcctcagcctccagagtagcttggattacagacacctgaagtgcctgttatgcattttcagaaaggtaactgcaaattcactgcctgattgtgcatcctccaactgttgttttggtgaggcaagtggaactttagcacagattgagtgtattctctcttaatatctatctgtaactcaacagatatttgcaaaatatagtcaacttctagtgctcacatcacattcactgacgtgtagcaaaatgcagctcctcttgaatattttgagatccttccaaagctgtattttgtcaacttttccctcacagccaaagaattgaactaaattttaatcttttgtctatccatgaatggtgatacttaagaaccaccggaatttttgttcttcatttgtttagcctataactaccttcatgtggtttctttgctctttcagtctccagtatttttctgagtaggattcagagcctaggcatctactgaaaataaacccaaatactacctctatttggaaagatttgcatcttcccagttgatttgtagagaatttctaaattgtttccagtagattcaatgtgatatataacattaacatttcataccaccagctgttttattaataacattttgatacatcatatatgacccaaagcagctttgattgcaataacaagcaagctaacacatggtacttgacagatagactgaaataatatggcagatctaaactgcttttcatttttggagggatattatcatttgcaatgccttgactgttaatttaattgtgttatttttaaaatataaaaccatatttcagtgaactgactcaccattacatttagttaattgtaaacctcaagatttgattactcatagttctcccttggttaatttacttgctcacagtattgacagaaaacatttcaaactaatatgatgggaaggacatagttcacatcactgtaggaacccaaagttaccaaacttttttggttcttttccttgtaaattgtattgcaagccatcatttttttttcacacactggtagtttaaggactgtagatcacataaagttgtaaatcaaatccttgcttactagtgagaaaggagtacaggataaactttgttttagagcatgcatgaatgattaaaaaaacaatttcagaaaactatctagtacaaagcaaatctagacagaatcattgcttcataaaggaccttaaggacaatctggctgaattccattttgcacatgaataaactgaagtccagaaaagttatatgatgcaatttctcctttattctggtcagtgacatataaagtatctctgcgaatccattttagagagttttaaataagttcaaatcaagattatgaattttggtattagtaaagaaagcactcaggcaaaaaggcttcattacctccatttggcatggaacgccatccaattatatgaagttttccattttgtgtggactttataactctaccactgactgactgcgttatctttagcccctgcttcacttttccactctagacttagagttttgcatttataaaatggagggattgatttagatgtttattaaagttatcgtaacacttaagaacttctctcaacattctaagcctcaagttggacctaatatacatgccaacaattataacagtcatacacatgcacacacacacacacacacacacacacacacacgggttatttttcaaactattatgttgaattctaagttaagaagaggatgtagaaagaatacacaatggggacaaggtagtccctccaatacatggtgggaaaacttggtattcacttcagagaatgaagttggacctttcagcaaacacaaaactcaactcacaatgaattaaagatagcctcaataaattgtttaaaattgaaatcatatcaagtattttctcagacctcagagaaaactagaaatcaacaccaagaggaattctagaagctatacatatacctggaaattaaacaaaatgctcctgagagttctttgggtcaatgacaaaattatgatggaaattaaaaacttttctaaaacaaaaatgaagatgcaatatactaaaacctataggatacagcaaaggcactgctaagagagaaatttatagagttaaattcctacatcaaaaaaaaaatcacaaattaataaccaaatgttgcacctcaagaaactagaaaaagaagagcaaaccaaactcccaacccaaagctagccaaaacaaacaaacaaacaaacaaaacaaacaaaaacagagattagagtgaactaaatgaaataaagaccaaaaaaatacaaatgataaaggaaatgaaatgttggttatttgaaagataaacaaaatggataaagctctagttggacaaactaagaagagagaagatccaaataaacataattaaaaatgaaaaagagacattactaatggtaccacagagatacaaaagatcgttagagactactatgaaggaatataatacactcgcaaattaaaaaacagagaaattggataaattcttgtaaatatacaacctccaaatattgaacaaggaagaaatgctggacagaccaataataagctgtaagatttaatcagtaataattaaaaacaatctcgcgacacacacaaaaaaatcctgggactagataaattcacggacgaattctaccagacatgcatagaagaactggtaccaatcctcctaaaactctttcaaagtatctaaaatgaaggaataatccctaactccttctacaaggccagtatttcctgaattccgaagacagacaagcacacaactaaaaaaggaaaactacaggccaatatccccaatgaacatagatacaaaaaccctcaataaaatactagcaaaccaaatccaacaacacagctaaaagaagcagaactaaatggtaatacaccatgaccaagtggtttttacacaagagatggaagcatggtacaacatacctgaatcaataaatgtgattcaccatattaacagaattaaaaacaaaaacaacatgaccatttcaatagaagcagaaaaacgcatttgataaaattcagcatcctttcataataaaaaccctcaacaaatgagactgggtaatttatgaagagaagaggtttaattgactcacagttaacacaggctgtacaggaagcattactaggaggccataggaaacttacaatcatggtggaagatgaaggggaagcaagcatttcttaccatggctcagcaggagagagagagcaagtgaagggggaagtgccacacacctttaaaccatctgatctcatgagaactcactcactatcaggagaatggcaagcggaaaattcacccccattatccaatcacctcccaccaccacttcctccaatttgacatgaggtttgggcggggagacaaatcgaaaccatatcaacatagaacatacatcaaaataataaaagcaatacataacaaacttacagccaacaacatattgaatggggaaaagatgaaagcaatcctcctaagaactagaataagacaaggatgcccactttcaccccttctactcaacatattactgaaaattctagccagagcaactagacaagagaaagaaataaaagacattaaaattggaaacagggaagtcaaattggtccactttgaagatgacatgatcttatatttagaataccaaaagactccaccaaaaaactcagatttcataaatgaatttagtatattttcaggacacaaaatcaaggtatgaaaatcagtggcatttgtgtacaccaacaacaatcaagctgagaaccaaattaatcccatttataatagctacaaaaattaaaatacctaggaatatatttaaccaagaaaatgaaagatctgtaaaagaaaactacaaaacatggatgaaagaaattgtagaggacaaaaacaaatgaaaatatataccatgctcatgaattagaagaattaatgtaatcaaaatgacagtactgcccaaagcaatctacagattccctgcaatctttatcaaaatatcaaagtctcatagctgaattacactagatataaaaagaagagctggtaccatgcccactgaaaatattcccccaaaaaattgagaaggagggactcctccctaacttattctataaggccagcattatcctgatgccaaaacctggtagagacataacgaaagaagaaaacttcaggctaatacctttgaggaacatcagatgcaaacatcctcaacaaaatactggcaaaacaaattctacagcacatcaaaaagcttatctacctcaatcaagtaggctttattcctgggatgcaaggttgcttcaacatgcacaaatcaataaatgtgactcatcatataaacagaactgatgacaaaaccagatgattatctcaatagatgcagaaaaggctttggataaaatttaacactccatagtgttaaaaaaaaaaaaaaaaaaacctctcaaactaggtattgaaggagcatacctcaaaatagtaagagacatctatgacaaacccacagccaacatcatacttaatggttaaaagccagaagcattccccttgaaaactggcacaagacaagaatgccctctctcaccactcctagtcagcataatattggaagtgctgggtagagcaatcaatcaagagaaagaaagaaactgcatgccaatagaaagagaggaggtcaagcaatctctgtttgcagatgacatgatcctatatctagaaaaccccatagtcttggcccaaaagctccttaagctaataaacaacttcaatgaagtctcaaaatacaaaatcaatgcataaaaattactaacattcctatacaccaacaacagtcaaattgagaatcaaatcatgaacacagtctcattcacaattgccacaaaaagtataaaattcctaggaatacagctaaccagggaagtgtaagatccctgtaggaagaactactgaacactgcccaaagaaatcagagatgacacaaacaaatggaaaaacatcccatactcatggatagaaataaataatatttttaaaatggtcatacttcccaaagcaattgatagattcagtgctattcctattaaactatcaatgacattcttcacaaacccagagaaaactattttaaaattcatatggagccaaaatgagcccaaatagccaaagcaattttaagtaaaaggaacaaagctcgggggatcatgctacctgagtttaaactgtattacagggctacattaaccaaaacagcatgctaggctgggcacaatggctcacacctgtaatctcaacactttgggaggctgaggcgggcagatcacctgaggtcaggagttcgagaccagcccggccaacatggtgaaaccccatctctactaaaaataccaaaaatgagccgggcgtagtgacgggtgcctgtaatcccagctactcagaaagctgagacagcagaatcacttgaacgcgggaggcagaggttgcagtgagctgagatcaccccattgcattgcagcctgggcagcaagagtgaaactccatctcaaaataaacaaactaacaaacaaaacaaaacaaaaccagcatgcttctggtataaaaacagacacatagaccaatgaaactgaatagagagcccagaaataaggccacacgactacaactacctgatctttgacaacactgacaaaaacaagcaatggggaaagaactgcctattcaataaatgatgctgggataactggcaagctgtatgcagaagattgacactgtaccccattcttacatcatccacaaaaattaactcaatatggattaaagttttaaatgtaacaccccaaactataaaaaccctagaatacaacctacgcaataccattctggacaaaggaatgggcaaagatttcatgacaaagacaccaaaagcaattgcaacaaaaacaaaaattgacaaatgagatttaattaaactaagagcttctgtacagcaaaagagagtatcaacagagtaaacacataacctacagaatgggagaaaattttttcaaagtatacctgtgacaaagttcaaatatccagcatctataataaacttaaacaaatttacaaaaaaaaaaaaaaaactgagtaaccccattaaaaagtgggcaaaggacatgaacagacacttttcaaaagaagacacacatgcaaaagaagcatatgaaaaaaagctcaacatcactgattattagagaaatgcaaatcaaaaccacaatgacataccacgtagcatgagtcagaatggctattactgaaaagccaaaaaaaaaaaaaaaaaaaaaaaaaaaaaaaaaaaaaaaacagatgctggttagttttcagagaaaaaggaacacttatatactgttggttggtgtgtaagataattcaaccatcatggaaaacagtgtggctattcctcaaagacccaaaaaaaatatactattcaactcaacaatccccattagaggattgctgtgttgaatggtattattatgcccaaagacatttgcagcactattcacaatggtagagacacagaatcaacctaaattcccaccattggtagactgattaaagaaaatgcggtgtatatacaccatggaatactatgcagccataaaaaagaacaaaatcatgttctttgtatgaacgtggatggatttgcagaccattatccttagcaaactaatgcaggagcagaaaagcaaataccacatatcctcacttataagtgggagctaaatgatgagaacacctggacacatagagagaaactacacatactggggcctattagagagtggagcttgggaggaggaagcagatcaggaaaagtaactaatgggtactaggcatagtacctgagtgatgaaataatctgtataacaaaccctcgtgacacaaatttaccgacatactaaacctgtacatgtaccccaaaacctaaagtacaagttaaattttaaaaaataccaatgtcattttcctaaaattcacgtggaaccaaaaaggagcctgaatagccaaggcaatcctaagcaaaaagaacaagggcagaggtatcacaatactgatcccaaattatacatcagaggtacactaacgaaaacaataagaaactggtgttaaaacagacacagagatcagtggaacagaatagagatcccagaaataaagccatgtacatacagccaactgatgtttaacaaagttgacaaaaacatacactggggaacggacagccaccctcttcaatggtgctgggaacattggattaccatatgccgaagaatgaaactggatccctgtctctcaccatatgaaaaaactagctccagatggattaacgagttaaatgtaacacctgaaattataaaaatatccgaagaaaacccaggagaaactcatctggacatttgtctaagcaattaattcatgactaagtcctcaaaagcacaaacaacaaaaacagaaatagacaaatgggaattaaactgaaaaatttggcacagaaaaagaaataatctacagagtgaacagaccactggcagagtgggagaaaatatttgcaaactctgcatccaacaggggattgatagtcataatttataagaaacttaaacaactcaacaacaaataaaaaaaagaccccattaacaagcaggtaaaggacatgaatagacacttttgaaaagaagacatacaaatggcaaacaagcatgtgaaaaaatgcttaatgtcactattcatcagacaaattcaaattaataccataatgagatattatcttataccagtcagactggctatttttaaaaaggaaaaaaagataacaaatgttggtgagtatatgtagaaaggaaatgcttatacactgttagtgggtgtgtaaattagtacgatctatatggaaacagtatggaaatttctcaatgaactaaaaatagaactaccattcaatccagcagtcccacaactgggtatctaccaaaaggaaaaggaattattatatcaaaaatatacctacacttatatgtttattgcagcactagtcacgatagcaaagatatggaatccacctaaatgtccatcaatgaatgagtggataaagaaaatatggtagcgatgagtggccaagatggccaactagaagcagctagtgtgtgtggttctcacagagaggaacagagaggaagagaaactgccagtaaacacaacatcttcaactgtaacatccaggtactcacattggaattgatccaggaaacaacttgacccacagagaatgaagaaaagcaagaccggaaaacagccgacctgggagcaacatggagccttgcccagggaagtggtgaatgaatgagcgaccctgggaaaccacacttctcccatagatctttgcaacactcaggtcaggatatgtccttgtgaacccagtccaccaggaccttcagtcttcagtctgacagacagagctacatggagctctgagcagctgctcaggcatgtgttggagaccctggagccttaaatacttgggcttactggcaaaggtagctgcagctcctgcaaagtggaggttagactatggtacatacccctaggaaagaggctgaatccagggggctgagaagcaacagcctgcaggccccacttccaaggcacgtcacaatataagacccactggccccacttccaaggcacgtcacaatataagacacactggtttggaattccagccagctaccaggagtggcattgcacctccctaagaaggagctccttggtggaggggcaggccaccatctttgctactggggcaccttagtagttccagccatcaggctttgaagattctgagctgacccagggcagaagggatcctcaagcatagcacagctgatctaccaaaacatggtcagactgctgctttaagtgggtgcctgatcctatttatcctcactgagaaggacctcccaactacggtctccagccacttcctacaggtgcttttggaacagcaacaggtttgtacctccctgggataaatctcccagagggagggacaggctatcatctttgctgttttgcatccttcactgatgacacctctgggttctggaaaatcccaggtgactagagactggagcgggccccaagcatactgcagcagccctaaggaaaagtggccagattgttacatgcgtgcctgttcccatatctcctcatctggcaggccctccagcctgtgcttccagccaccccccgccagagctgttgagccagtacaaactcagcaactccctggacagagcctccaaaggcaactgaaaacctctctgccactgcctctgctgtggaactgtccttgccacccccagactaatgaagaagcaaagaccctaagtgctttatccacatctccaacaagctacagacacaaggagaggccagtcagtctcccccatgccccacacaactctcacggttcataaccagacagtaaacccctggcttgggcccaaagcacaaaccttctctcttgggctgactggatggagtgattgcttacacctgcatctctctctgcggtagatcccccaagagtcaagcaaaataacccttggccacaaccaccaagatctcttcatctgctgcctctgagctggggaaggaacataaacactgagatcgcctaggaactgcagtgggcagctaaggagtgccaagtcatgaactacagcaagcactcaagggggagaggaagccaccctttcagagcacgagagggaacacagctgcaactgtgaggaaacataggggagccacacaaccaagcaagggtctaccaactgaccagtaaggctaagtgtcacctgctggatcacatcccaaagcttcaaccccaacaatactttactaacatttccccatctgaaaccagagacaaaaagtcagcttcaaataaagactctacacaaagccttggcctggtgaaaacatccaaaaaagaagtctattgactgtattcaatttacactgcaattaaaggaacaatcacacacagagatgagaaagaaccagcctaagaactctaataactaaaatggccagagtgtcgtatattctccaaatgatcacaccagccctccaacaagagttcttaacaaggcaaaactgcctggaataacagaaatagaattcagaatatggataggaacaaagatcattgagatttaggaggatggcaaaacccaatcccaggacaatatgaatcacaataaagtgatacaggagctgaaggacaaaacagtcagtgtaaagaagaacctaacgtgtcaggcagagctgaataacacaatggaagaatttcacaatgcagtcacaagtgtcagcagcagaataaaccaagttgataaaagaatcctggaacttgaagactggttctctgaaataagacagtcagacaaaaataaagaaagaaaataaaaatgaatgacaagaatctccaggaaatatgggattatgtaaagaggcaaaatctacgaatcattggcacccctgaaagggaaggggagaagcaaacaacttggaatatatatttcagaagattgttcatgaaaacttcccaaccttgctagagaggccaacagtcaaattcagcaaatacagagaacttctgcaagattctatacaagaagatactccccaagacacataaccatctgattttccaagattgaaatgaaagaaagaatgttcaacacaactgaggaaaaagggcgggtaacctacaaagggattcccatcaggctaacagcagacctctcaactgaaatcctacaagtcttaagagattgggggcctatatttattcaacgttcttaaagaaaaaaatcttcaaccaataatttcatatccagccaaatgtagcttcctaagtgaaggagaaataagatcctcttcagataagcaaattttgagggactttattaccactagaagtgtcttacaagggatcttgaaaggaccactaaatatagaaaggaaagatcactaccagctaagacaaaaacacacttaaacacacagaccagtgttactgtaaagcaatcacacaaacaagccaacatagttaccagctaacagcataatgacaatatcaaatccacacatatcaatactaaccttgaatgtaaatgggctaaatgccccacttaaaaggtacatagtggtaagctggataaaaaagcaagaccccatagtattctgtctttgagagatccacctcacgtcatgacactcataggctcaaaataaagggatgtagaaaaatctatcaagcaaatggaaaacagaaaaaaacaggagttgcaactctaatttcagaaatacagatttccaaccaataaagataaaaaaaagacaaggaagagcattacataatggtaaagtgttcaattcaacaagaagagctaactatcctaaatatatatgcacccaacacaggaacatccagattcagaaagcaagctcttagagacatacaaagaaacatagactcccacagaataagagtgggagacttcaacactccactgacagcattagatagatcattgaggaagaaaatgaacaaacatactgaggacataaactcagcattggaccaaatggatctgatagaccttcacagaattcttcaccctaaaacaacagaatattcattcttctcattgccacatggcacatactctaaaatcaattaagtaattgaacataaaacaatccccaacaaatggaaaagaaccaaaatcattccaaacaccttttcagaccacagctcaataaaaatagaaatcaacacaatgaaaatctctaaaaaacatacaattatatgaaaattaaacaacatgctcctgaaagatttgtggtaaataatgaaattaagacagaaatcaataagttctttaaaaataatgagaacaaagatgcaacataccagaatatctgggacacatagaaggcagtgttaagagggaaattcatagcactaaatgcccacataaaaaagttaggaagatttcaaattaacaatctaatttcacaacagaatgaattagagaagcaagaactgatcaaccccaaaactagcaaaagatgagaaataacaaaaatcagagctgaactgaagggaactgaggcccataaaagccattcaaaagatcagtgaatccaggaattgtttttttttttttttgaaaaaaataaaataaaataggccactagctagactaattaagaaagaaagagagaagatccaaataaacacaattagaaatgaggaagggaatgatactactgaccccacagaaatcaaaacaacaatcagaagctactacaaacatttctacacacacaaactagaaaacctagaagatatggataagttcctggacacatacaacctcccaaggctgagcctggaagaaattgattcccagaacagaccaataacgagctctgaaattgaatcagtaataagcctaccaaccaaaaaaagcccaggacctgatggaatcacagccacattctaccagatgtacaaagaagagctcacacaatttctgctgaaattatttcaaacaactgaagaggagggactcctccccaacttattctaagagaccgtcatcatcctgaaaccaaaacctggcagacacacaacaaaaaagaaaacttcaggtgaatatccttgatgaatattgatgcaaaaaaaaacctccacaaaaatatttgcaaaccaaatcttgcaacacatcaaaaagctaatccaccataatcaagtaggcttcatccccaggatgcaaggttggttcaacatacaaaaatcaataaatgtgattcatcacataaacggaactaaagacaaaaaccaaatgattatctctatagacgtagaaaaggtttttgataaaattcaacacctctgcatgttaagaactctcaatgaagtaggttttgaaggaacatacttcaaaataataagaaccttctatgacaaacccacagtaaacattatactgaacgtgcaaaagctggaagtattctccttgaaaactggaacaagacaaggatgccctctttcatcacatctattcaacatagtattggaagtcctagccagagcaatcaggcaaaggaaagaaaaaagggcatctgaataggaagagaggaagtcaaacgatctctgtttgtggacgatatgattcagctgacacataacttcagcaaagttgcaggatacaaaatcaatgtacaaaaattactagagttcctatacaccaacaacagccaaactgagagccaagtcagaaagacaatcccacttataattgtcacaagaaattaaaatacctaggaatacagctaactagggaggtggaagatctctgcaatgaggactacaaaacactgttcaaataaatcagagaagacacaaatggatggaaaaacattccttgcccatggataggaagaatcaactaattaaaatggctagactgcccaaagcaatgtacaaatttaacactattcctatcaaactaccaacaacattcttcacagaactagaaaaaaataaatttatatggaaccaaaaaagagctggaatagccaaggaaattctaagcaaaaagaacaaagctggagaaatcacattacctgacttcaaactatactacaaggctacaatgaccaaaacagtgtggcactggtacaaaaacaggtgcatagaccaatggaacaaaatagagagtgcagaaataacagtgaatatctatgaccatctgatctttgacatagctgacaaaaacaagcaatggggaaaagactccctatttcataaatggtgctgggataactgggctagtcatatggagcagattgaagctggaccccttccttaaagcatatacaaaaattaactcaatatggattaatgacttaaatgtataaccaaaaactataaaaaccctggaagacaacctaggcaataccatcctggacctaggaatgggcaaagatttcatgagaaggacaccaaaagcaagcagaacaaaagcaaacattaacaaatgagatctaattaaacttcaaagcttctgcacagcaaaagaacctatcaacagagtaaacagacaacttacagaataggagaaaatatttgcaaactatgcatctgacaaaattctaatatccagcatctataagggacttaaacaaatttacaagataaaaacaacccctctaaaaagtgggcaaaggacatgaacagacacttttcaaaagaagacctacatgcagcgaacaagcatatgaaaaaacaactctatatcactgatcattataaaaatgcaaatcaaaattaaaatgcaaatcaaaatgggtatcatgaaaaagaaaaaaaattaacatatgctggcaaggttacaaagaagagggaacacttatacactgttgatgggagtgtgaattagttcaatctttgtagaaagcagtatggggattcctcaaagagctaaaagcaaaactaccatttgacccagcaatgctattactgggtatatacccagaagaatataaagcattctaccagaaaggcacatgcatgcaaatgttcactgcagcactgttcacaatgctagggacatggaatcaacttaaatgtccatcaatgatggactggataaagaaaatgtggtatatataccctacggaatattatgcagccataaaaaggaacaagatcatgcctttttggggaaaatggatgaaactggaggctatcatccttaacaaactaaggcaggaacagaaaaccaaatactgcatgttttcacttctgagtgagagctaaatgataggaacttatgaacacaaagaagggaacagcagacactgaggtctactttaggggagagggtggtggaggatatgagcaaaaaagataactattgagtactgtgattgatacctgggtgatgtaataatatgtacaacaaacccccatgacatatgtttatctgtgtaacagactttctcatgtacccccaagcctgaaataaaaagtttaaaaaagaaataaaatatgatttacacatacaacatgggatactatttagctgtaagaaagaatgacatgtcttttgcagcaacatgcgtagaactggaggccattactttaagtgcaacaagtcagaaatgaaaattcaaacactgcatgttctcacttataagtgggagctaaatgacatgtatacatgcgcatagagtgtaaagtaatagtcattggagattcagaagggtgggagggcaggtagggggtgagggttgagaaattacttaatgggtacaatacaaactgttcggatgattgttacactaaaaatccagagttcaccaatacacaatatatccataaaactgcactggtaacccttaaatatatacttttatttaaaaaaaatggagttaaatataagacctgacatgacaaaactgatagaagaaaacatagggaaaaaatttcttgatattggtcttggcaatgatttcttggatatgacaccaaaagcatgggtaacacaagcaaacatgaagtggtactatatcaaactaaaaagcttctacacagcaaagaaagcaatcaacagagtgaaagggcaacctacggaatggaggaatatgttttcaaatcatatatataacaaagggttagtatacaaaatatataaggatatcctgcaactcaataacaaaaaataaacgctaaaagccaagaccttatctctatgcaatatatggatgtatgaaactgacacttatacatcctaaatatatttaaataaataaatatatatataggcaacagagctgaaaatattttttttcttgaaataagacatacaaatgaccaacaggtatatgaaaaaacatgttcaacatcactaatcatcagggaaatgcaaatcaaaaccgtaatgagatatcacctcacacttgttaataggactattatttttaaaaatatatataagaaatattggtgaaaatgtggattaagagaacgtttgcacaattatattggtgagaatgtaaactggtttagccagtatggaaaacagtatgttggtttctcaaaaaattaaaaatagaactatcataccatccaacgatcccacttctgaatatatatgaggtaaaatcataatcttaaagaaatatctgcactcccgtgttcattgctgctttattaacaatagccaatatattaaaaaccctaaatgaccaacaatggatgaatggatttaaaaaacctggtatttatatattatatacaatggaattttattcagcttttacaaagaatgaaatcttcccatttgtgacaacatgaataaacctgaagcatgatatgctaaatgaaataagtcatacagagggacaaacaccatgacaccacttatatgatgaatctaaaatagtcaaactcatggaagcagatattagaatggtggttgtcgtgcactgaggagaagaggaaacagggtgctattagttgagatgagcaaagtttcagatgtacaagatgaataagtcctagagatctactgtacagcatagtgtctatagttaacaatactgtattgtatacttaaaactttgctaagagggtaggtcttatgttacatgtttttatcacacaaacaacaacaataatatataaagtggacaggcagaaacttatggaggtttatggtatagactatggtaatggtctcatggatatatacatatgtccaaactcatcaagttcatgcagtatatatttacagctttttgtatctgaatcatacctcagtaaagtagtttttaaaaaagaaaataacaaatcaaataacttaataaatatgtttaaattataaaaagaagagtgtagagtaccataagggctatacattatgacttggtcaataattacagtgactagacattgaggcaataatgaaattaagtgaacaagaatagaaggcattgaggatacagaagtaaatgctcagttatcggtaagtgcaaaatgtgaatgttttcccagtaacattgaatctctgcctttccaaaccaatttcaatgatttaaatatatgtaatttgaacataatgtaaatgtgttattttcagattcagtgactgaaaaggacaacttttatacttttaggtgtatgtgtgactttttacctatattgtagcactttcacttttaaatgcatcttttcattttcatctaacttactattttctagttgtccggtgcaagttgaaattttggttcccaagtaaaatttaactaagtaactcctgaatcagctttatgtattgccctttttatgtatcattccagacctgcgttttgagaacttgtggccaggtgctaaactgctattctaaatctatcagtgttacactgagaagcttcctgaggataagaatttaattgaacagttgaataaaaggccaaattgctatgaaaaattcatatgaaccaaaacatcttttccactgctttcctatccttgagtatagttttatctgaagacacagatattcaggtgctgtactgaagactaaacaaataggatttaagagtttcataagcttaaagtcactgcaattatggtataaattatggtgatggtttcatgggtataaacttagctccaagctcatcaagttgtacacattatatatgtacagatttttgtatctcaattgtacctctgtaaagtagttttttaaaaataaaataaaaaatcaaataaattttttctgcaccatgaggcaatacaaaatatatgttatataggctatacctctaaactttgaataaagtgtaaggagctatataaaagacaacaaaaaatgcatgaccatatgtggtaaggagatcgtatcctttagagattttttttttaactcatgtgtgagctactttaggactttaacaaatacatctaggttccatcaggaaacttggtcttctgctccatatcttcacctaaataactgacctataatggttcaatctgagactcagtttcctcatctgcaaactgaagaattaaactagcttctaaatcttttgtacgaattaaaaatatgtggggagtctggctcattaattctcttaatatcatcataggagacaaacattttacaacgaattttctttatctgtgagagggtttagatatttgtatacctttagttttcagagttaggaagcatatattgttcactgaaatccattatttaccctacaaataataaaatacctattaattcagtaattatcatagccaggattcagttctgaggagccaatgtaaattctggaaacttattgatacagttttgattatgaggcacccagtcatggtgatcctaagcaatgtccatttgtttaaatcattgccatcatattttctgtctagacataccctttgggagctgaatgggttatctgggggactggaattttataaagctaaactagatgtggcaagaaaatctctttggccatcaagataatgtacaaatgtatatcatcagtttagatactaaggaaatttcccttcagattttttctttgcgatgatttagagacaatctaatgtgatgaaaagtttgcttcattacgagttttctatgcatcataaggagtacagaatggcaaaatagaaccttagttattctaccaaacacacagttagacggtttaggctgtatttacctcagcttacatatttgataaggattcaccttacctcttagaatcaggatcttctaatgacagttatgtttcttttttgaaaaaccaatatttgccttcttttccttgaatcacgtttttatggtaggatgaattttactgaattctgaaataatccttcaaaatctaccagatttttctttttggcccatggtagcagtgtaccagtagatgattagggacattatctaaaaataattaagttgaattcactagactttttggaggacatcgttggagtatggattgttctggtacttttagtacttgtttccttatatatggttgtgttgctgtctgatatagacttcctaggagaaataatttcaaacttgcatattcactttttaatctatggccattaccccacaccccacctttttataccattatgctgagagctttattttaatatctgacttttattaatacaaaagattataactatactacagacgctggctatataggtacatgccatattttcattcatttggtccctcagtgtataagtattaggcagataaaaaggtagaaagaatacctgaagtcttttccttcttctccccctccctgctaagctgatcctcataggctaggcagcctatcctttataaaagtgccagcaaggatatgcactagaaaagggttcctttagatatgcactaatgaggatacacactcaaaggggtttcatttagaatttcagagtgctcccactgacaatgttgttttagatggaatttactacatagtgaattctgtccaaaataactgtccaaaactcttagcagacaaaagaatacattagcaagagtcttggaattttttaaactatttgcattttactatctttgttttatttgtgtttcaaattggggatcagatatatatttaatatatatttttctaaatttataaactattcattgtagcatgaaggaattataagaattgaaagttacattgttaaaaatattaacaaattcaagttaattttggtttgtgctatgtagcatagctctgttaaataaatttatccagctttcaattacattaagaaatgatccccattttacaaaggatcatccatagctcaagcctcagtatcatgcaatattttcatgtgaaaagcctgcacttgtacccccaaatctaaaataaaagttgaaattattaatataaataaataaatggaatggaataattctgcttttaggtataacagctgcagcgatggctgaggcgatgaaacttcagaagatgaagcttatggctatgaacactcttcagggaaatggaagccaaaatgggaccgaatcagagcctgatgatcttaattctaacacaggtgagtgtcttccagaatcccagaccaatgactcttactgttctattgtggggcaggagagaggtgggatgaggatggaggagagaataataagtctactttggttataaagatactcaagagggatgattagctctattgctaacatttgtacactgaaattagaaaacagttacaagtcataatctcattttggaaacatttagttatcttcactgttttgctgtggtagaattgtattataattcctataatgttagccattgtgctctctgcctgacaaagactggtccactcagcatcacctcaggtttcttattccatcctattctaaataatttaccactgaaaggcaatgctgacagtccaggttggctgggctgaagtcttttcagctggagtaccacttccttagctaaaggaaagtgctggctgactccaggcattatcaacagggactaatgaaaagaggtagaacagggagcagccaaagaagaaaagatggatgaaaggaaaagaaaacagaggtgacttgtagagtggaaagtcctctcctctcatgttacttgtttctttcttttaccccgtgatcattgtaccttggccttgatcataagacccttcagatccctttggaaagtaggtgggattataactatcaacatacatgaatggatggatggacggatggaaagatggatggatagataaatggatggatcaatggatgatggaaggatggacacataaataaaggaaagattgaagaaatatttaattttattttaggtttaggagtacatgttcaggtttgttaaatgggtaaaaacatgatttgggggtttggtgtacatactgattattttgccacttggatactaaagatagtacctgacagttttatttcttttctgaacttctccctcctcccacccttctccctcaagtaggccccagtgcctgttgttccctttttttctgttcatatgttctcatcatttagctcccacttataagtgagaacaagcagtatttgattttatgttcctgcattagtttgccatggataatggcctcactccatccatgttcctgcaaaggaaatgatctcattgctttttattgctgcatagtattccatggtgcacatttcccacattttctttatccactttctcattgatggacattcaggttgattccatgtctttgctattgtgaatagtgctgcaacgaacatatgtgcgtgtgtgtcttcatggtagaacaatttatattcctttgggtgtatacccagtagtgggatggttgggtcaaagagtacttctgtttttagttctttgaggaatcaccatactgctttccctaatagttgaactaatttacacttccatcagcaatgtataaactttcccctttctctacaaccttgccagaatctctattttttgacttcatagtaatagccgttctgactggtgtgagatggtatcttattgtggttttgatttgcatttctctaataatcaatggtgttgagcttttttcatatgcttcttggtcacatgtatgtcttctttagaaaagtgtctgttcatgtactttgcccacatttgaacagggttgttttttgcttgcacatttgtttcagttccttgaagattcttgatattagacctttgtcagatgtatattttctcccattctctaggttgccttcttactctgttgatagtttcttttgctgtgcagaagctctttactttaataaggtcctatttctcacgttttacttttgctgcaattgcttttggcatcttcttcatgaaatctttgccaattcctgtgtccaaaatggtatttcctaggttatctccaaaggtttttacaattcgaggttttatatttaggaatttaatccactttgagttgatttttgtatatgctgtaaagaacgggtccagtttcagtcttcggcatacagctagccagttatcccagcaccatttattgaatagggtgtccttttccattgcttgtttttgtcagctttattaaagatcagatggttgcaggtctgtgactttatttctgggttagctattctgtaacattggtctagtgtttgttttgtacctgtagtatgcggttttgtttactgtatccgtgtaatataattcgaaggcaggtaatgtgatgccttcagctttgatgtctaaaagcgtggtggaagggtgcgggggagcagggtgactccccattcccagtcttgcacaggtccctgtggggagcatgaacctccctgggggctctcattcactcaccctttccatgtttgggagtttctcctggctattttaacaatattgattcttcctattcaagaacatgaaatgtttttccattcagtaatgaattccctcagcatttgcttgtctgaaaaggatcttatttctccttcgcttatgaagcttagtttggccggatataaaatccttttttttttttttttttttgagacggagtctcactctatcacccaggctggagtgcagtggcacgatcttggctcactacaacctctgcctcctgggttcaagcaattctccctgccgcagcctcccaagtagctgagattacaggtacccatcaccacacctggctaatttgtgtacttttagtagagaaggggtttcaccatgttggccagcctagtctcgaactccttacctcaggtgatccacctgccttggcctcccaaagtgctgggattacaggtgtgagccactgcgcccagccaatattttttaagatgctgatacctaacaggttggtggccagctttgttcctctctgtcctctgtttctgactgctgccttgatggatcccgacatgatttctctgttgattggcctgcacggcagtggtctctagccctttgctttcttctccatgagagccgtgcacatgaactgcttctagttcatcatctcggccctgtctcccaaacatttttagtaaaaaaaaaaaaaaaaaaaaaaaaaaacgcaattaaagatggttttaggatccagagatttccaagctaactctgcagttaaattcaatataatgtgataggtaaattggcagcagctttacatctctttttctaggctcctggaaattcaagcatggtggggctttattttgcagggaaatgggaagagcaattaaagaggaaaattattgaatgaaatcagtatgagaaactactctgacttcaggacagtgtagatcacctcatgtaaaattacaattttcatggtgaaatataagatgagaattgctcttcaaccagtgctgacagtgacttttttctacatagcctggatgcaattttctggggaatcaatggaaaattcatattttactgggttcttggaaactgaaaacaatccatagataagaataaaattaacactaaacaataataatagcaacagcaagaatagttactagttactatgtgctaagtatctcacataataactcatttaatttttacctaaatcttgagaacaaggtactttcaatactcccattttatagatctaattatccttatcttgatgtaatgaagtgaagctgacttgtagtattataatcataattattatatagatttaaatgaagtttctgaagcatttcaaagtctgaataaatgaaaaccctgctctactggaaagtgaaactactacaatttcataaatgatcatttgtaaatgaaaatgtatttcaagcattttagatctgaaaatttttggtaatctgggggctagtgtgtctttgttgccctttgggtcacctatctcaccatataaactgagaccaaagactgggcttgatttctctgtttccaacttttatctgctttagttccttccaagaagcgacagaagtagatcatttcaacaagggagatcagggttcatagcatttatggtctgattattagttatgggaatgttctttctgaatgctcatggttcaagtaggactgggaaatttaatccaaaggacagctagatcttggagaaacattaaaactttgttcacaaaataagtactagatctaatcaggcaaaagaaaagcagtcaatttggtaaatattcagttgagtgggctgtgaggtatcctgagggatacacattgaatgtttccatcatttatgtggtgacatagaagtgagatttacattatgataaaatgcagttattttcaattttgttgtaaagaattccagttgtatatttgaagtgactagcaaataatagacattccatgaaggtcaagtacgtaaatgaaataagcagtgtggctagtgactatttctaaaccactccatgagggattagagtaattcttgaatatgattctcaacaaaattcaatttcatatatattaggctccacaatgtacaatattccaacagttataaaggcaatatgttggtagtctgaggagagaagacaaaaaaaatcactgtatttcaaatgcttatgatttaggtaggagaggagataaaaatgaatcaatatataaatgactatactctgacatggaatgtaataaaagcaacaagaagaactgtgacaatatagagaaagaaaaaattacttctaagataatcaaaaagattcaattgtaggatgtagcatttgaactgttctttgaaggagagaaattggacatcagaaaaaaagtgcatagctttgaatgaagtattaaacagattgtctcaattgtgttgagtgcctccagaccaaggagtatatcatcaagactttgtccagtgcgaagagaccaagaaataaagctccccccccccactaatctgtacataatggcctcggtgattacatagatcaatgactaaaataaaacaagccttcaaaaaataaacacactgtactattcccctggacagtcattttcaaatagtgattctcagagacctcaggacatttctaggagttgggtaagaattgaggacatggcttgaggaaattttatgtttgattactagaaagttttgatcaattacatttttaggttaactataaagcacctgttgattacaatcttattgacaaagatttctaaaattaaaatttagagtcctaagtaacttcagataattagatcccaacctctcatactacagatgatgtttgaagcatgagaaattggccagtaatcacacagctaggtagtgagagatctggcactgattcatagttccttgatctttccaccataacattatgcttctaatgtttgaatcaattttctagtatagtttaagctacataatctaatttctttactttatattgaatctcaatcagtaaacctagagatagagatgcagctgataaaggagattgtccttaatttggcttgactaatattttgttgacaaaatagttaccagacttcagattagacctgatctgacctcaagatctactctgggaattactgttttcactacatctctgatagattttctttcttggtatcatcttttttctcttcaattaagtaagatatagataacaaatatttcacttgaagttctgaaactgtccaattaatcaagccataaaatacatacatatgtattaaaatacatgtgtgtgtgtgtatatatatatatatatatatatatatatatatagtgaagtagtgttcagccataaaaatataacaagatcctgtcatttgcaacaacattgatggaactggaggttaatacgttaagtgaagtaagccaggcacggaaagacaaactttgcatattctcacttatttgtgggagttaaaattaaaatgagtgaatacatggagatagagagtagaaggtggctcagaagggtagtggggggtgaggtgaggaggtgatgtggggagggttaacaggtacaaaaatagaaagaatgaataaaacctagtatgtgctagcacaacagggatactatagtcaaaaataatttagttgtacatttaaatatagctaaaagaatgtaattggattgtattctttgtggataacacaaagcgtgaatgcttgaggtgatagataccccatttaccctgatgtgattattgttttgtatatctgtatcaaaatatctcatgtaatacataaatatacttaccatgtacccacaaaaattaaaaacctagttagatccacaaatattataaattattaaatatgatttagaattttatattgttttaagtgtaaactcaatgatttagagccctgctctgaaatcaagctgagtgcatgttacctttcctgttttctcccttatgagtggcatttgttttaataggacactattaaaaatataaatgaatggtctctctttgttgaatgtatttttggtcatatgaacattttacttgagaaaggacaatttttggttcttataagccgttttcacaaggtttgtgtagccagaaaattttaaaaatgagtttgtttttcaatttaagagggagcacactctgttttaaatgccttattgtggtaggattgctatttaatttcatcattgttattagtggctaaatcccctgaaggcaaaatatgacagatataaaaacatgccaagtattcaattaaaatttttctgctggtgttaatatgtttatctatcttgtcattttaaaaaggatcatattttattttctcagcatattccttgtaactttttattctagccccccattacccattgattcttgccatttaattgtggaggtactggcttttatttgtgaaaggctttatcaaaatacagattaaaatatcatgttttcacaattgaactaaacagagaaatgtacagcaaagtactatcttcctagagggtatgagaccaaccattgtgcattttgctcttcacaaaaaaaccaaccagcattgtcagagagcacatacttcatgacctaaggaaatttccaaatttattgacacatcctgaaataagcgggacactgacctaaaaatactggaaggctgtatttagttgagatgtttgaatgtgtgtgaaaaagagttttcctgctgggagttcttacatcttctattttgcttaagttgatatttttgggtgattcgacaagagcagagacaggagagtatgaaaatagagtcagtatcattaagctttaaaggaaaaaagcaaatataggagttagaatattcttatgcaagaaccgaattttctctttgaaggcagacctatagtttctttgatttgaggtttgtttaatagtttccataatggctgcaccatgactctgcatcaagatttcagcatgaataacaacgtgttcatgtttcatttagctccaaatgagaaattctgttttttattgttttaggaaattagtctgtgtactatttctcatggagctttataatcaatcactaaaggttatggctgtagagagtttgtgggaaatagatgcttgaatgattataattgtagctgtcaaattagaaatatagttatacagtagcagaatctatttttaaactataacaaagacttccagggttgcccatttacttgtagaaataaatggagtatttttaactgcattgcttatttcaggaagaactatgctcagtgatgttctctggaaaacccacgattataaccacgtaaatctttatcctccgagtccctgctttttctgacttttgtgtcagttttgcttccatggagcagatgttgagtactttaccttttggaaaatatagcttatagtggagagaatcaaagtgtatatggttgattaactggcaaagttgaattagaaaatcccaagattgccttctttctttatgttatccaaacatctcattagatgtggagaaagatgtttctagggaatcaagcgaggcatgctgtttttattagctcctggtaccaagaactgttttgagagggtttttttttctgatagaattttcaactttcactactctacccatctttcttctgtgcttatgactgcttaaaaagtaagccagaaggaactattgttttttcagtacccttctataactcattccaggagtaagcaactctcactactggggaattgtttattatgtctattcctaatacctcatctagtgaattacatttcttgttttgtcagtaatattaaggtcagtttgtatgaagccacctcagagtttggtctaatgttatctcttcctcacaattaataatttgaaatgatgtgatctatccttatagatcttattagccaacacgtaatcattctgatcttcctagtcctccaccttcctcctgtccccaactatgctattatcaaatcatagggcagaacttcacttttgagaagatctaatcagtgttgaatatgttgtcttggttcctacatgttattctcatttaatgtttctggttttttgtacattaatgctaaatatctagctctgctacagttttgtgtggttcaaaacaagtgatttcaaacaagcatcctctctttgtgccttggttacaatgaacgaatctgagataatcacattgcctttgaattctaatcttcattattataattcttgagcatcattagtctagtcccatcttctgtttgtattgtttttacttaatgggtactctcctgaatctgttgctctcatagtccatactatttattccttacagaatctttcacttagtgatgtcacttcaggttctgaacccttccttagaaatttgaggttagtgtcatgggatcaaaatgtgcctctgtccatgttcagtacactgacagaaatgtttttcctgcttttgggatttggaaaatactttttttgtattattgcctcaacttaacatttattcatgggtgatcactcttcgtgcccctgctgggaactctcttcaggtgtgtgatctgactggattttcacaatatattgatgagccaattgtttagaatggtctcaaaaaccttagtaaagtcaaaataaattatatctattgcttcccctctatctcccaggctgtcattctgtcacaggagattagattcgcctgacaagactcaatctttaggaagccatgcagggtgttatccagcatactgttcccttcaaggtatttgcaaattcatttgcagtatcttccaagacacacgtgttatccttgcaggttaagtacaaacaggtaaaaaataacagaatgggaaaatataggcaatggttcttaaactgggccaaaaaataatagaattttattttattttctacaacctttgaggatactattgtcatatctatgttagttgagagattgtgttcataaacggagtttacaataagtaattattggtatacactatcatttaagaagtattccttcatgaattaactggaacatgacaaaatattcaatagtaatttgcttaatacaatgccagatttcaaagttaatttacagcatatattgattttgagtatctacctctttagagtatatatgtatctaaaaatcaaaataatagtaattctgcactgtcatggtatacatatatactcttattattttgtttctgtttacttttttaaaggcagtttaataagcatatagtttcacatagagttgagctcattaaatatctccaacatttaatggattctactttacactggacatattagtgtaagggactcagaaataatcaccattattttttctaaatcctaattttctatgatcctatactcagatattaacatcacagtcatggatatgatcagtatatacagtgaacctagttcatgcattgaactcaagtaataaatacttgtgcccttatggaaaggtttggacgttctgtagtgtccaaagtgaaaattttatgagttttattgaggtaaaattcacataccataaaattcactcttttgaagtgtacagttcagtggttttagtatatttacagaattatacaactactatcattatgtaattctagtcctaataacttattatcaaattccagaaatattttatcactccatgaagaaatcctgtacccattaggatgcccatttctctgcatccgcaaagaacctggaaaccactaatctactattacattgtactctctgtatggatttacctattctggatatttcatgtaaatggaatcatacaatacgtgacctcttgtgtctgacttattttacttggaataatgtttttaaggttcatccatattgtagcatgtatcagaacttcatttattttaatgcctgaatgagattccgtttatgaaaatactacattttgtttatccatttatctgttcatggccatttgggttgcttccactttctggctactataaatgatgttgctataaacatctgtgcgcaagatttgtgtagacatatggtttcatttctctgggatatataccaaggagtagaattgctgggtaaaatgataactctgttgttaacactttgaagaaatgtcaaacattttacatttccaaagtgaattttgtacattacatattcacagattggtttcaaaaaatagattttcatacaccatgcatttcctggatactctgcactctatggtctttcttatgcaaatttcttgatattccaacattgtagttcccctttttagaggcaagctgatcctgccaagtagcagaaactttaatgccctctataataaaaacaaagattgtgactttaaagaaagtttaagaagtgaaatatgattgtttggttgatatgtacagagaggaattgacctctgacttttctaaagtttatagtataaacaatatagagcaagaaaataaattatgccacataggggtcatcatagtagtattgtcatcaaaaccaatgctttcatagacacagctctactagaattagcctagtattctaacccttggcttctggtcacatatggggtaagacagttcagattaagggggaggaaatgtaggcagagtaaagtaagaaggtatcactagttgggacaaaggcatgtctattttacttcaaaaggtgggaggtggctcacgcctgtaatcccagcactttgggaggccgaggcgggcagatcacgagatcaggagatcgagatcatcctggctaacacggtgaaaccctgacactactaatactaaaaatacaaaaaattagccgggcgtggtggcacactcctgtagtcccagctagtcgggaggcaggagaatagcttgaaccaggcaggcggaggttgcagtgagccgagatcacgccgctgcactccagcctgggtgacagagcgagactccgtctcaaaaaaaaaaaaaggtgggagatgggggttatgtaagttctttctactgaaataacatgaacagtagtacaaggagagaagaaaaagcaaattctggggaagttgccactgggtgaactgtcttaaggtacagtctcataggttttggcaagtccttaagggagttatatcttcctagatttttttctcttctcttctggcttactatggagaattatgcctaaatcttaaaccttacaacagttaaataagacccctttcaaagggattaacacactgaatattatatacatacagatttatatttatgcgctatacacatatatagtctttatctgtatataaatatgtgatgataatgataaaaggataatgattacacgtaggataaacatttatcaaaaattgtactataaataataaaacaataaaatataaagtgaaataaaaaatagaacacaattatggacagtgaaaattagtagctttttaataataagacaagaatatagttggagaaactttcaagaaaccgctattaagaccattgactctcggagtaaaaaaatatagaaacaatgtaggcactcactgtaggaaatattcatttctctgctgtatgagagttttggtttttaacttactgagggaagttgatgggcacagattctaaagagtatgtttcctttcagaattagatataattaatgaagtaacataagacactttctcagagctaaccttatctttaagtaagataattttatggactctgagaaattgtcatgtttctgccattgccatctcttaggatgtgtttaatgcaaagcataaagttaattgtaaagctacccagggtattatatttttgacacttatcagttgtttacatgttagtgtgaatcaaagtttgagagctaatgctgatgagaggagggaattccctggatagagattttaaacaacaggagagaaaaaagaactaaaagttaggatcccagacacaaactctgcctgtttcaaagtttacctcattcttttctgaacctgcaatatttcctaatgaacggtatttctaaatcttatttaagatgcctaacttctctttcttggcaaaaaaaaagaagttgttccttcacaaggatcattctccatgtggaatttgacaccatgtccgcttaacctaatgcgttatcagaccaggtctcttttttttctacatgaattaaattgtcaagtctctctagctgcatcataaatggttggttacaagtgcctcctctaggtgatcatcataagatcctaatgtttatcttaaatggcttgcagaaatttgcaaagaaacctctataaaccattaggactgatttgcatctaaatcatttttaaccaggaggcaaaagttattttctgcagatggtcagggtttatattttataggcagcagtgtctatgaaaaatacaaaactcattatagaaatagagcacaaatgctattcccttcttactttctggcttttagacttgtttctactactgggagaaacatcaatggaacatcaatgcattgtactggagacagtacctgttcccataaaacactgagcaaagaacaaagcatttgttttcctagtgtagatgctgaagttaacatgcattatttaataaatatatttttgctttctcaagagatatatcaagcagtagtaaatatttcagtgttatttctttaggaagttcaaatgttttgagtgtagaacttcttttgggagggtaaaggtggtgttggtcgggaggagggagggagttggaggaatcaaaggaatgaggaaaagcatcatgctgtaaagtttgattgttgttctacctctttttccaactatacctgccatggagttttcttataaatgcaaacatccttcataatacgtttaaaaacaacaaatacatcacttgcatgaatatttaaggaaccatcaggaggggaaaaactcattggtttaatggaatgctgtcaaggcaaatcaacatcatgaaagacactggggcagaattgatacctttgcactgacatgttaaaagaaaagcccatgcattatttagaaaacccagaaatctgtcagctgcatgattgccgagttagcagatgcaggaggattctgcttgagttgaaaagaaatgcgtaggcacagatccatattgtaacctttcatgttctacacccaccatgaattctcagctattatgcagtcagcatttttgagtttttcttttttaaattttcaagtgcttcgaaaggcaaaaggggtacatcttttagtctaaaaaagcaaaatgcctaggctgttattttagtgttagagtaaagatgacaagaccaaagattgtttttcatgtttctgagtgttgtgcaaggttccccggagtgttttgaagttgttacagtaggtattatttttacacatttatcccatgaacaaagtgttttcttaaccattttgccttcaataaacataaggaaacactttattttactgatttaagcacatcagcatgccatttataaacatggaaagttttatagtctactaatacaaaaatgaatttatagatactatacatgtaagcatttaaaataattttattgaatacacaagggcagcattctctagcaacatcttgtcaaaatatagttattgacatccttatgcctttgaattacccctatgaggcaagtaagaagccagtattctgactattatcatagaagagacaaagagaggcacaaaagaatcaagtgtgtctcttaaggttacatattttgacaataagagaaaattagtggtaatagagccaagattttgtgttttcagtctagtgagcctaatgtgttttctactctactgctgcatctcaccatttctctgtaagcctctctgcatttataagtgtttaattgttgctaagccagaaaatacttaatgaaaatcttctattccatattagctgctaatttatagccaacgaaggaaaaatcacaaccagccaatcacgattaatggcatagaattagaaagtaatatttttttgtatcatctatattttggaaaagtctgtccagatagatttcaggaagttaattgctgatgagggttcaatttaaaattatatattactttgttaaaaaaaaaaacctacaaatcttttgatgggatttccactggaaataatgaatagcaaaaatttataaaacatatgttattccctgatttctgggtcgctagcatttctatggaaacagatgtgcatacttcgacatatagatggttaaactttcttttcataagttcttgtggattttgtattgcatacaggacttctttgggaggaacattaatttacacttttttattttcagaaaactcatcatcatcactattatatgctatttctactggcaaaataacaataagtgaaaaattcaggaagctaaattaatattttgagtcaacttgtagaatggtctgaggtctggattgtcattttgcctggttcctttgcttctggatgatattttctaactgtatcctctctttttcatctccaccaacctctgtttactcctcttctctactacgtctaccagatatattaagttaataaaggcattcatatacttcagcaatgtttttggagtgggatgtgtgtgtgtgtgtgtgtgagagagagagagagagagaataagcacatgcatgctgaagtgctgaagcacctgcatcaacattactatcactacagtcatagtccaggaaagatgtctctgctctcaagcaagaaacaagaactaccatgatggtttgggaatgaggaaaaataagagggtgaaataagagagtgtatttgacattaagttgggaaattgcagaggaagcaacctaacattaggtgttaaaagacctggattctagaaccacctctgccaagaagtagctgcaaatccaggcaagtctctttctgtacctgagcctcagttttctgatgtgtaaaatagtaagtgggataagattacagtaaagacaattctagctgtggcaattctccctttgtacatagagtaatgagttattgctgtcactctaattgcagaagggaaaaagagaggtgtggcaatacataggtaagatgcccatttagtttaggaacagtctgtaaagaaactttagaaaattaataatccagatattgtttcattgccaattcttcattttcttctagaattctagaataactacatttccttcatacatgttagaaaacactgagttgctgtatgatgcatcttaacagtgcatagtaaagcatgtagccctgggccgggcatggtggctctcccctgtaatcccagcactttgggaggctgaggcaggtggatcacttgaggccaggagttccagaccagcctagccaacacagagaaaccccatctctactaaaaaaaaaaaaaaaaaaaaaaattagcctggcgtggtggtgcacacctgtagtcccagctgcttgggaggctgaggcatgagaatcacttgaacctgggaggcagaggttacagtgagccgagactgcactccaccctggatgacagagcaagactctgtcaaaaaaaaaaagaaagagagagagaaagagagagagagaggaaggaaggaaggaaggaaagaaggaaggaaggaaggaaggaaggaaggaaggaaggaaggaaggaaggaagaggaagggaagggagggaggaaggaaggaaggaaggaaaaaagaaaagaagagaaaaaaagaaagaagaaagaaaagaaagaaagaagaaagagaaagaaagaatgaatgaaagaaagaaagaaggaaggaaagaaagaaagagaaagaaagaaagaaagaaagaaagaaagaaagaaagaaagaaagaagaaagaaagaaagaaagaaagaaagaaagaaagaaagaaagaaagaaagaaagaaagaaagaaagaaaggcaggcaggccctggtcttaaccactttccttccacaataaaagagtaaaaggattgatgtaatatattagatttgtcattattctttaaagagttaaaattcaaatgaggagacttctctctcctttccctgtaggaccagagccatcatatttaactttcttcagtttagaattgtttggatctccatgagctatatggcttaaaatactatgaacaggaacactttaaagttctgtttggactacttgaaacaaactttccataagaaaattgtaagtaaataaagtgaaaaaaatgtgtccttcagacattcagcaatgtcttccctggattcattaacgttaatgagaactgcacatttcactgaaggaaaatatatacctcttagtttatatttcatccatatagggatattgcatgaaccactttacttggtttatttattctgttaccttccttgtatttgaagaattagcactgtgttttaataggagaaaaaaataactttgtcttattgaatcaaaattacctacttgaaagtaatctattttcttatgcaagttttgttgtagcaaatttactttgaagtatgaggaacatgtctttgtagaacataacgagatacctccaggcacctaccaagcaatagagaaggaatttttcagtctcttgttaatttccatatgtactaaatgcaacacaataaaaactaatgacaaaatgcaagtagcacagcctaagctacgtaaaataaagcatttttacatgtctataacttttctgatctttgacaaatttatagtctctaagtacagaggtctaaatcttcaaagcttgaaaagcagaggtgcagcatgaactaatcttcatttttcccctatcttcttacagcagcattaatggaaatgtattttgtttaatgactctgaaatcctgtttgtaattagatgtgggaattggtcttactttgtaacagatgatactggaataataatatgagagatgctacactgagaccactatcctcctaaatctatatcatttttcattttattgacaagagatgtgtacaagaaacaaagaaattgattttaaaagggaagaaaataagatctaataaaaacttccaatccaaatattttagtgttattttcaatatgttgcagtggggaaaggaaagagtatgcaccttgtttttaattttaggaaacaagggttttggatttgttgctttattcctcataatgatctctgaatattattgcaaagactaggtagagaagtttaattaagtgacagatatcatatcattgaagcatgtattatatgttaatatggttatacaaaataatatcttttaaataaaaattttatattcaaacaaagaatttaatgagttgacaggctaaatgtaacagctattccgtatgttatgtacttcatcgtcagtaaaagctacagtcacaaatcattctggtcactgaagacttactaatacctggaggtcttagatttttttcttgtttaatgttaatgggctgcaggggccaaaaaagtagcctaaaaagaaattatatgcattaagaataggtttcatcttcccttcaaaacacatgtattattgcccattgataatagtaagaatgattggaagtattgacacattcttggtggtgtttccgattatacctatctaatagtatatgattatcaacttcagtcatgttgcattcgtttgctttccaattcttgttttagacccttcttagtagatacaagaattggcaaaaaaagatattatatattggtcatttatttggaggctcacatttgtttagcaatttagttcacaaagcagtttcacatcaacatatttcctttgattatcatgaaaattctataaggcaagtagagcgagtagtgtcatgatttctcttcggtattagaagaaactaaggcccaaagaggctcagtgatgtagtaaagttcaaatagacagtatatggtcaaatacatgaattttaactccaaagcttacattattttcatggcaaaataactcattgtaaataaattaaattgagaacacatatggttccatcaatgtacaggttaatagattttggtgacatcataatgggtaagaacacaatgtaattagaatggaaattttcctaaaccctgggttcatgactctgctcacactgccaagcagtagagtagatttcagtttgatgatggtgaacagcatcttttatttgctatgataactagcattaggttttttttttaaatggtatgtaacactgtcacaggggtctctatctttttctttcttttgcaaaggaaaagacagctattacaatcaatttatttgttctttgtacatgcaatctgttagtgataaacgctaataaaaataacctgtttgagctcaaatgtacaaatcaactgtaagggagtctagctgcttcattatgaaagctccttatacttattcaacagtgtaatacttgtctgtttttcatttttatgttcattagtctagaatagtgtcttacataaagttaggatgataaatatatcaagaatagatcaattatttcacctttcacacaagtttccggccgagactaggcactcaataataaacatttgatgaatgctgattgtgtagtgtgccattgcattctatatgttatgctgagagttatgtggattactttattgtaggacatactgttattctagctctgtcttcattatagacaaagattcttttgtcaataaaaacaaagaattgcctctctctgcaatgtccaaaacaaataaataaataaatagaaattttataataaacattgatttttcttctaatcaggctactggccagaaaagaggtgcctccttcagtagaaccctgtggattctaatgctgttcccaacctaagcttgatccctataatggccctacatcttagggatgacttatacgtctctgcctatctttttggctgatgaacaacaacagcttttaacagtaaactaatggttcatccactaattagcagttgaccttggccttcatttatgttaatctcaggtttccctatcagtaaaatgatcgttttaaaggttcctttcttctgaaatatgctctgttaccataaggacaaattacagtatgttgactctttttaaaatctatagcatgaagaaatagtatatggacattgttatagtgactaaattgaccatcatattttaatttaccccttagtgaggctctattgtcttttctgaggagtcggtgctacatagccatttggtgcagatagaatcgctagtgacacatataaacaggacaggatgttttcaataagatatattcacaatccaaattcattgtgtgtatttccttgcattgaattgtttcttttgttttagtaacataacaattgaatcacatttgagtgacaaaaagtctgtatgtcttctctgccatatgagtataaaatggactggtaaagctagaaataaataccattattttttagcactacagttctctgtgaccttcattgtgtatacatgataccttctaattcaattaagatcagccatattccacattaggttgtatgataaaatccataaaggatattgcaacgaaaggtattaatttggtaataccagattaactagttttagcttgtgaacttgataccaaaagtgttatagaggctggtatggtttgtatttgtgtccctgtctgaatctcatgttggattgtaatccccaatgttggaggagggtcatggtggaggtgattgaatgatgtgaagatttcccccttgctattctcatgatagtgagtgagatctcaagagagctggttgttgaaaagtgtgcagcacctccccctttactctgttcctcctgttccagccatgtataacatgcctgcttccttcccctttgccttccgccatgattgtaagtttcctgagacctccacacccagacttactgtacagtctgtggaagtgtgatctaattaaagttattttctttataaattatccagtctcaggtatttctttatagcaatatgagaatggaataatacagaatattagtactgaggagtggggcattgctataaagatacctgaaaatgtggaagcagctttgaaactgggtaatgggcagaggttagaacagttgcgagggctcagaagaagacaggaagatgagggaagtttggaacttcctaaagcattgtggagtggttttgaccaaaatgctgattgtaatatgaacagagatggccaggctgatgaggtgtcagatggagatgaggaaatttttgggaactggaggaaaggtcactcttgctatgctttagtaaagagactggcagcattgtgcccatgctctaggtatctgtggaactttgaacttgagagagatgatttagagtatctgacagaagaaatttctaagcagtaaagcattcaagaattagcctagctgcttccatcagcctatgctcatatgtgtgagcaaagacacaatctgaaactggaacttatatttaagagggaagcagagcataaaagtttggaaaatttacagcctggctatgtggtagaaaagaaaaaccaattttctgtgaaggaatttaagctggctgaagaagtttgcataagaggtgccaaatgttaatagccaagacaataggggaaaatgcctcaaagggatttcagagacattcatggcagcagcccctcacatcacaggcctgtgggctgaggagggaagaatgatattgtaggctggacccaggaccccaatgccctgatcaacctcaggacgctgctccctgatcctagctgctctagctccagccatggctaaaagggccccagatatgtctcagactgctgctccagagggtgaaagttgttggccttggcagctttgacattgtgttaagcctatgggtgtgcagagggcaagagttgaggcttgggggcctccacttagatttcagaggatgtatggaaatgcacagatgtgcagacagaagcccactacagtggcagaatcctcatggagaacctctactggggcagtgtgaggggaaaaaatgtggggttgaagccaccatacaaagtcaccactggggcactgcttagtggagctgtgagaagagggccaccatcctccagaccccagaatagtagatccactgacgacttgcattgtgcacctggaaaagcggcagacatttaatgccagcctgtgcaagtaaccaagggggccatacccgcagagccacagaagcagaacttcccaaggtcttggaagctcgcccccttgcataagtgtggtctggatgtgagacacggagtcaaagaagaatattttaggccaggtgtggtggcttacgcctgtaatcccagcactttgggaggccgaggcgggtggatcacgaggtcaggagatcgagaccatcctggctaacatggtgataccctgtctctactaaaaacacacaaaaaattagccaggtgtggtggtgggcgtctgtagtcccagctactcaggaggctgaggcaggagaatggtgtgaacctgggaggcggagcttgcagtgagccaagatcatgccactgcattccagtctggggacagagcgagactccgtctcaaaaaaaaaaaaaaaaaaaaaaaagaagaagaagaatattttggagctttaagatttaatgaattccctgctgggtttcagacttgcatggggactgttacccctttgtttgggcttatttcttccttttgcaacaggtgtatttatccaatgcctgtacccccattgtatcttgagagtaactaacttgtttttgattttacaggttgatgggcagaagagacttgccttatctcagatgagactttggactgtggaattttgagttaatgctgaaataagttgagacttgggggactgttgagaaggggtgattgtattttgtagtgtgaggacatgagatttgggaggggccgggggcagaatgatatggtttggatttgtggccctgcccaaatctcctgttgagttgtcattcccagtgttggaggtggggcctgttgggcggatttcttccttgcagttcttatgatagggagtgagttatcaagagatctggtgttttaaaagtgtgtagcacctcccccttcgctctcttcctccttctccagccatgtaggacatgcctgcttccccttcatgctttcaccatgattctaagtttccttaggcctccccagctagggaagcctgtacagcctgtaaaagcatgagctaattaaacctcttttctatgtaaattacctagtctcaggtagttctttgtagcaatggatgaatggactaatctaaggcagaacctttggataattctgttccctacataattccccagaatgctaaaacttcattgtaaccctcagctcttctctttgattttctctattctctttggttagtgtcaaaatttattattggtgcatttttgcatgtgtactcagaggacattgttcattactcttttctgaaataagcctttgatagactctcaaaagagaaataatttgccaccgtctagccacagtctcttaatttgacaactttagaagtcacaattcattggactttactagccactgggctcaagaaataagcagtgattagaacttgaactacaaatattcaaatgttctaccagcaaagaaggctgtaaagcctccattgtcaagcttgttctatctcgaattgattcttatgagggtgtacatacagttggttttgatattttacagctgaatggccaaaagagcagaatagaatcatattcaatggaaattttagctcaggatccactcattaagatgttgaacttatttcagataagcaatgtcagtgtgaatagaaatatcttgagtatctagtgtttatcttttctggctccagaatttcttattgcaaaaatgacaagtctgttacccttctgcattttttctttgtcatatccaaaaactgatgaaaatacaggatttctgctttgaaagaaaatgaaaagtatttcaagctagttttataatctctgagcaatctgggctcatcatccactcctcttctacttgtatttgctttaaagaagtcttgccccatgcttttatgtagcacagcctaacatcagatacttgattcttagaaccaaatggagtagccattcagtaatttccttatgctatcttttaaaaatattggaattgaaaaaaacaacatgtaatatgtataaattattagtgaagtcactagacaactcaagaactaaaagattatcaaaagcttgcatttgcatatatgcacatcccttttcccatccctctgcctcccaaccaaagataagcactctccagaattttgtgtttagaatttcaccacttttttatgctgcttatatttaaataaatatttatttatagaaacaacttatagaagcatggaatgccagatctggaaggcagctttgagatcatccagctcaacttaataattgtacaagaaaggaaactgaaacctataggaggcaaactgaggatgtctagccttttagtgggaagataatcatcatttgagaggttggaaaattactagtattctatgattctatccatttatttataattgcaacataaaatttgatattaaggctaggtgcagtggctcacacctgtaatcctagcactttacgaagtcgaggcaggtggatcacttgaacccaggagttcaagaccagcctgggcaacatggcaagagatcgtccctagaaaaacacaaaagtttgctggacatcgtggcacacgcctatagtctcagcttctcgggaggctgacatagaaggatcagctgagcccagggtggttgaggctgcagtgagtggtgattgtgccactgcactccagccttggtgacagagtgaaacactgtctcgaaaaaaagtgatattaaaatgtttaacattaaaacttggtgctatgagtctgaaattaagagtttttttttctttttttacttaaaagtatacaatttgtaagagaacatatttacagataaactgcttatcaaacttgtttgtattgcatttatcagtctctaaattatattataaaccaagagcctcagtcctattgaaaagtaaaatttaaagatgcaataaagtctttttgaaacaatttcagtgaaaaataatttccgataaaaatattaatctgctctgattttatttagaattgtattgctgaacatgtgtgtgcacatacacatgtgcatgtaatattttcagactagctgagcatagtattaatttccaaagtattccccagaaattgtagcatattatttctttgattttatggtcatcaccttaaataagtaataacctaagacttatatctgatgacttgccattgtcacactacataccttggctatgtaagggaaattgtgggtaaaatagcagatatttagctgaagaataaccttttctaaagttccttaaaaccttaaaaagacattggtgctttgtaaacacacccataatgtttttctaatgtttatcaactaagcctattgaaactgaagcttctagcactccacctgagaaaattgaaggaattctgaatccctttgtaaactaaaggctctgtctttgatttatctgttcttacatccctagtctgcctacagttcaacctcactagtttgtatgaatggggtggcagtaactctgaaatacagaccagcactgaccaatagaactttctgcgatgatggaaatgttcttccatgctgtccatcatagtagggttggtgtgattgaggaactgaatttttcattttatttatttatttaaatttaaatagacatatgtgtccagcggctactatatgacacagctcagataaaaaacaaacaatttaatttgtgttttcaagaaataagaatgtaaccataaagagtcctcatactgcatgtatatgcctgaattgatcaacatttgtaattagcataccgtttgttttgaaataaatacttttaggttgttggttttgtgagcgaaacaaatcacagattgaaaaagcatttatcttgccacattccttttcatagagtgggcaaaggcatccatcaccccacactagattagtacagttacatattctaaatttattagtttagttttactgttttctcacaagaagtaacaattcaaaggcacacagagatatttacaaatgagataataagaataatttttacatggcaaaatagagaaaaaatatcaacggagatactgcacctcaaaatatttaatttctatgttagcatcctcaactaaatgcccaacatagccatttctgtagttagaaaaagagatttcatattttaagttagtcgctgcctaaacatatttgtgcttaacttttgacagagttgccattttcatttaggaagcataataatgaaaataacaagcttaatataaatatgtaaattttaccttagaaaatactggttttgccaatctctaaagatgccttaaagcatgtttgtaaagctggccctgccttttcatcacaaactatcaaaaagaatgcaatttgcacactattctcctaaaattaaaagataagctgcttttcactcactctgaagagttctcttggcttctaatcatgtaaaaatgaaagaactgccaatttgtcctaaacactggaccacaattacggtaaaatgggcttcagattctcactgtattcaggttgtaaacacttgcctgacaacaactgaaagcaaggaatttgggtatttggaggtggatattagtcctaaagtataacaggtgtagtagccctcagtaattaggacattaagagactgtgtgagaaacaactttaccaaacaactaactgagttatcagaagtgaaaagtgaattctcaagttttataaagtataagagctttgggaagtgtgtgtttgtcattatggttaatttgcacatacctcactgaagaaaaggccaggggagctaggccgagaacacagctgtacaggcagctcaactaattgcctatccatcctcaacctcatttatcttcatttcttcccaattataccaaattatcaatagtctctgttgcatcagagtcttaatcccctttattcaggcagcattagatagtggcagatgaatacttggagggagtcagggtaaacagccatgaatgccacctctggcagatggcattgctcagaagaaatgtgacaaaacatttggagtttgtaactgggcattggtatgaggatgcaagctgttaatatttttttaaaggtaatcaaggtggtacatggtaaaaatgcaacccagattttaaagaaaaatacaagggtgcaggtgttcacaccaacttaaaataatacatttttagatagtatattcccactgagcactgtaaccatgaaattttttcagaccatgatattttatgataatcagtggcctatttccatttgaagcaaggcatacatgttctgtattcaaagacaaaatattatttatttttctttccaatcaaataacagactgtgaaatatttattgtgtccattgccaaattggaaatatgtttcaaaattggataacaaattgaacagccaaaagaaaacatgttagtgagaaaagaatgtttgaaaacatttacaattactacagttttcacttggtaaaaataagacaataagaattaatgttttgtgtcatttacagaaatatcaatactataatagaaatgtaaataatttattttcattcaataatagatttggtactttgcagaaataatcacataacttatgtatgcttttatgaatttgagtttcaggagcatatgaactatagatgttatcacatagatggaatgagtaaataaataaataagaacaatcattaaaatgaaacataaaaaaaaataggctgctttcaagtattttattatcaagtcatagatctttttaaaagagccagctgatttatctttgatattttctagaataggtagcattgctttaagtagtggtatccctttcatctttgtcatttacatattggtgctgaattcaattgcatgaacacaaattagatttcttggtcagaaacagagaaggtgaaaagtagacaaaactatggagctgcctgttcccttggtatcttaggttccagatctccatgtccttttatcctctccttctttggctacacctaggcaactgtatcttccaccatcctccctgtcctacacagtcctacccaagttatatcccacaaatgttctttcccacctccatttctacaataatttaaattttttatacttactttataaaatatgtctgaactgtctagactgcatgaggtaagactgtatgaattgagtcattaatcaactttggaaggtaataattgcttgcttttaaggccttttgatttgaaatccagtttcttaggctactctgtatattgtgcattgttaggacggcagagcttaggaagtttgtgtgaatgcgtaggtatgaattacccccacacacatctatgaagaactatttctttttactttgagctcggatgtgtgctgttttctgttctacaaagttctaaaacatacatattgctattgttgacaatgcacaaatattttcaacacatgaaaactttaaaatgccaatagttttgcaatgttattaactttgaagttactattattttataaaactccaaaaagttaaactgtagcatacagacttcgctttcagtgccaggcataggttttatatgtctctctctctctctctctctgtctctgtgtgtgtgtgtgtgtgtgtgtgtgtgtgtgtgtgtgtgtgtattcccaaatatatttaccatgccaggttgtcagccttggaaacaagtctgtaaattggccaaaagcatcacacattattttgctgtaagtgtctgctacttttgctgcattgccaaccctaataagccgagcctgtgtggtgtgctggtgcatatttaacctttcctccttacaggaatgggtctgagcttaacggtcattatgtattaaaatttggtaggctgtagccaatagagaatctcatactaaattatactgtgcaactgaattcgggcttgtatgtgaaagaatacctagtctattagtgattcacaagatttttatatttaggcaaaatagactcatttgtttatattctactccctctcttgttagcatactatacatagtatgaagagaccaactcaaataatttaatgatggcaaaatattccgttttttaaaaagatccagacatctcaaattgtactgttgttaagatcaatctttctcctctctcttccaaatctaattgaattttgaaattgaatattgaaacataactgcatgctttaaaacttttccaactattgtaactgctctggagaaactaaaagttcttaaagatataattatcatccagccattagcacaaaatatataatcatattttgtaaacatccatctattgtgtgcaggtagtgaaaactgcagctaaactattaatgtattaaattgcataagttaatccaatgtttgatacttttctttgaaaaatatgtccaaaggaacaatctggaatgaaaacaaattaccagacactattttttactgccctgttgcctaacgtgtgttgaatgaccatttggaaagcaagtcagtgcttctgcttaatcacttgaaaattttgtgcatattttaactatactcatcattgttttatttaaaagaaactaatggccttttcaaacaggaaatgtattttaattattgaattcataatgactcatttctttttttttttttttttttgagacagggtctcactctgtcatccaggctggagtgcagtggtgagatcatagctcactgcagccttgacctcctggactcaagctatcctcctgcctcagtacctgagactacagatgcataccacatggctggctatttttttaattgatttttattttttgtaaacatggggctatgctatgttgcccagcctggtcttgaccccttggccttaagcaatcctcctgcctcagcctcccacattgctactggtgtcagtccttgcatccagctgccctcgaacatttctaacatcagtagacagggattggatactatgccttccatatgcatctatgtatctatatatgtatctatgtatctatctatctgtgtgtctgtctatctatctatctatctatatgtctgactcctttctatcttgcttgatataattttcttgaatttgtttctttatgatatggtaagcatttcatattaacaaaactgcaacttgaaaaggatgtgttctcttgttttggtcaagaaaagcagacaatcttattcctaatgcttgtctagcacactacttgaaaaataattttagctgctcaaagagaagttcaggaattgagtataataaaaacagtgtttaaaaagttttctcggccagctgcagtggctcatgcctgcactttatgaggatcatttgagcccaggagttcaggatcagcccgggaaacagtgagaccccatctctacagaaaatagaaaaaattagctagacatggtgttgcgcacctgtattgctagctattcgggaggctgagctgaaaggatcacttgagcccaggagttcaaagctctagtgagccatgattgcaccactgcactccagcctgggtgacagagtgagaccctctctctctctctctttctccctctctctctctctctatatatatatataattatatatgatatacatgatatcatatatatatgttatatataattatatatatatagtctacttgtggcatttttattgtattctgaattagatatattttcattactttaagcccatggcttttagtatttttttctgatcattaaagaagtgttattaatcacattggatgtagtaataatgccttttccacttaaatcattgttttcaattgtggaattaagccttgtatgttctatccttcttttagtgattggcttccaagaaataccattattttcccactcttttctcttcaggcatcaacttggcccttttccttcagatgctttgcagccttaccctcattttcaaaagacagagaaaacactacccataattgactcatatcatttatattttaaaaagacttcactttaaaggagggacgtgaataagaaagtagctttcctatgccacttggaattgagggattttctctgaaggccttcaatacttcatgattcccaggtctgcccactacagatctcagcctagtctagtaagcctatccttgaaactaccgctttcttagctctcttcaccaaagtgcctcattttgttcctcagattctaaactgtgcacattcacagtcaaagcctcagttaaaagcacttatatgcctcgtatcagtaacaattgaggatagtgatttagtgtgtgtgttctggagtctttcctggtttgattctttactggtggtacaagcgtgggaaaatcagtcttttgagtttcagttttctctataaaatgtggctgattatagcacctatcacatggtgttctgaggattaggtgaatactttctaccacacgtcaagtgcccagtgtgctttcagcgtttttcaggctcacagtgtgtgttcagtgaatgtgattttcacaggtattagacatatatgtggtaagtgttttgtaagcagcagccggtaactgataattatagttttaattactcagtgtagtgataaaatccatttatgaatctctttgatatcatcagcagtaattcataagccccagtgtaatacaagtgaaagatccattccatacactcataggcactaagatcccagagccagtgaatgttccatgtcaaatctatacttgctatgtattgattctatctattgatttattttacttctactccattttcttctacttttatttttcattaaaaaactgtatttccttatcctttttttccatatagaataatttttggtgataaaattagaattattcagtctaatgcctcagcttaacaaacatgtttctttctctttgtatttttatttcaggctctgccatgtatttcaatttgtcatattttccccagttttatagatttctgtgaatttgagtctgcgagttttatctttatttgggtaaaatgattatttttttcttgcctaaattctttcttttttgtgtctttcatgttcgtgttgtatgcttgcctctttcctcttatcttttgttttatcttgtattcagtttacagcaatatgaaaattattggcaaaagttattctccattatttctaccaactttctcctctttcttcatattaaatattttgttctttcttatcattcttcttttaagaagtcctaggattaataatcaatgtttaccagccaaacccagtcttttctgtacagagagaaaaaacaaagagccatctgcttctgctttctcaagaggagaacaggctatatatagttgtttagtctcactgctgaaccacttgatacattattagaagtagcctagtaaagccgtatctggagtcctcattttcagtgttttactgtatcctattatacaatctgctttaagagcaacaagttttttgcacatggccatgaaaattaatgtggttaactgcaaaaataatagagctttacctttgcaaattattcctttaattcttggggtcactagtggtcttcatcatcttttgttagtagtatagttaaaaaggtagtcaccctatagacaagttaataaagttaataccctattttgtcctttatattctaaaaaaacttaaatgataacagcttacacttatttagtgcttgatatgtctagatattgtattgctttacatattctgtcccatttaatccttaaaacaaccctagagtaggtagattatatttccatatcagatattaagaaactcagactcaaagaaccctaatgtcatttccaaagcccatagatattaaatagagtggccagaattcaacatcaggtctgtctgatgctccttccactatgctattaggattttttgaaggatacaattcttccctctctattttgcgtcggtctctatctgccactttcatagaactttgccagttgaccactaccagtcaagtaagatcactttaacctcgccactccaaagcatacagacaagctgaaatctcaacaagaaaactttctgtgtgagtaataattaactctcaccattggccacaaaagatcataatgctttcatatcgatttattggtcaacatgaattctgttgtctagagactgcattatggtttccctaaataattttttgatagctgtaagaattgcactgacaggaagatatttatacctacagaaatgatattactttgtgtgcagggataaaaagaagagatgaattattctgcctccttctatgtggccagtcttgccctctgctttttggtttaattcattagcttctaaagcatggcgtatttggttaaattaacagtgtaatagaaaaagtactttaattatgctttgggtaagtatatatacttaaattatgttatgggtaggaaaataaattatgtaggtatatatacttaaattatgttatgggtaggtatatatacttaaattatgttacaagtagataaatctatttaaattatattatgagtaggtaaatatacatccataatattacacttttacaacactaatttttcatcttcttagttgatctatgaaaaatgagtgttgtaaatatataatattacaatgtatatttttaaaaattttctgattgattatgaaaaaaactgtaaatttgtgccatttaaattttttgtaattcaaggcagtcattgaaactctatgttcatacactctatcaggtaaataataagtatgctcttttagtatacataaagtaaatttcgagctgtatacatgtactaacatatgcacacaaaatagaaattaaatagaaataattaagaagattaaacaagattttaactaataaattttattaattacataaaacttttaaaacatatattcttagtatcagtgaggacaatgtgattaatacatcaaaactgatgacctttacaatattttacttcttaatgaaggtgacagagttcctacattgagtagaagtatcagctctgctattttatatctcttctcctgtgcttgcattattgtcttcaatctgaggttgtattgtgttgttcactttgtaaaggctagtttattgaatccactcagttgagtgtacatagaacatatcacaatgaggtcagaataaataaaagtctagggctgccaatggccaaccactgccctgctgaaaactcctactctttttttcctctggattcctctaatgattgagtggtgaaggcatcagtgatggttcatatcttaaatattagtgacacataatgttgtacttactttttggttacatataaaataaatattaaaactcaaatatcttgctctatctttgtaggtcagcttttacattttctagggtatgcataacctcattttaagtaactccaatttaagatatatcttacaagagcacatgtcacagcttataaattctaggaactagctctttaaaataaataatttgcctgtattctcagtaattgttcaatagttcagaaatatgacaaaagaggaaaacgataaatggtggttctgcttggcttctggtgaagcctcagggagcttttattcatggtggaaggcaaagggggaataggcacatcacatggcaaaagcagtagcaatgaagagagggtgagggcgaggttccacacactttaaaataattaaatcttgcaagaattcactcactgtcaggaagacagcacgaagccataagggttccgtccccatgatcctaacaccttccaccaggccccacctccagcattcgaaattaaaattcaacatgagatttgggtggggacaaatatccaagctatattggtggtattacatgattatttactgcgaagtgacttgataatatgtttgtcatttagacagaccacatgttattaagaatgaaagaaggaactcaaattcagataagaaaatgctatcactgtcttgaactcagatttttcgagtctttcaacttgcaatacttacactagcaagaaatgaattcaaatttccaaaaagtgtcttgtcacacataaacaaatttttctgtacttgccacagcagagagcttagatagaattgaagggtatttttattttatttatttatttatttatttattttttgagacggagtctcactctgtcgccaggctggagttcagtggtatgatatcagctcactgcaacctctgcctcctgggttcaagcaattctcctgcctcagcctcccgagtagctggggctacaggtgcgcaccaacatgcccaactcatttttatattgttagtagagatagggtttcaccatgttggccaagatggtcttgatctcctgacctcgtgacccacccgcctcggcctcccaaagcgctgggatcacaggtatgagccaccatgcccagtaattgaagggtatttttttaaaaaaacttctgctccaggcaacataacataataccaagataaatatgacaatttaaaaatttgggggtttcataggagagtgaataagattatcatttgaaattgcaaaataatatctggcaaaaccccattttcttcatgtctacaataaaatatcttttaaccagagtgtattttaagttatgcaaactaatagtttgcaagagtttctccaactatatcatcacactcagcaggtcatatggaagagcactgtgccttcatcacttgtgatacaattccttctacaactaaactaatctttgaaactcaataatgtgatgtttaagttttagccactgtgctttaaagtggcactcagggaatacttacatcttgcaacattttaatttagaaacaaagattttgggactttccttgaattttacatttacttcgtgaaacatattagccctatttttagaaatatgtatgagttaggtgcaatttatttgagtaagcctgtggtgagtacttatattttttaattattaagtctactttgaagcatcagttccttttaaatccagaaataaatttgttcactattaattttgaaacatttgaatttgactcctgatctttttggatcatggtgatgatacaagtatagagtcatttgtttgatttttttcatttgtttgtttggttggtgggtttgcctgtaaagataacgcagccagccaacagacatgaaaaaaaagctcatcaccactggtcactagagaaatgcaaatcaaaaccacaatgagataccatctcacaccagttagaatggtgatcattaaaaagtaaggaaacaacagatgctggagaggttctggaaaaatagaaatgtttttatactgttggtgggaatgtaaattagtttgaccattgtggaagacagtgtggcgattcctcaaggatctagaaccagaaataccatttgacccagaaatcccattagtgggcatatacccaaaggattataaaacattctatgataaagacacatgcaaacgtatgtttatcgtggcactattcacaatagcaaagacttggaaccagtccaaatgtccatcaatgatagactggattaagaaaatgtggcacatatacaccatggaatactatgcagccataaaaagggatgagttcatgtcctttgcagggacatggatgaagttggaaactatcattctcagcaaactatcacaagatcagaaaaccaaacaccgcatgttctcactcataagtaggagttgaacaatgagaacacatggacacagggaggggaacatcacacactggggcctgtcagagggtggggggctaggggagggataacattaggagaaatacctaatgtaggtgacgggttgataggtgcagcaaaccaccagggcaagtgtatacctatgtaacaaagctgcacgttctgcacatgtaacctagaacttaaagtataataaaaaaaaagaaagaaagaagataatgcttatgtattcatacaacatttgtagtgcaagttggtccatccatcacactctctcagagtcttagcacatttcttagaaccctttgaaggtttgtatataaacattctggtcatgcaaccaaggtattcttttctttcttcctgggtactgctctgctcagttttattctcttctttttaaattgtcctttctgatactccatcttctttatttttgtttttcatgtttatttcagtcgttatgtcaagggccaattggaggagatgaggctagtagtaggaaagtcagttaagagtctcttgagatgattgtaatgtgagagagtaatgagggttcaaacaaaggcagtgtcagtgggaatggaagggaacccagtgtaaagtcaattccagataatttggccacttaagcacagagtgaatggttaaagagatgataatgatacttttattagactgagagatctttgagggcaagggatttgccttttatttctatattctcagtacctgcaaatagcacctgacacatgttaagtactcaaaaatttcccattgaaacaattgcattatgccactaacagatacaggaaataaaggagcaagatctctttcattgaataatggtcaatttagtttcagacatgttgaattgaagatgctgtagatacctgtgttttaaattgttttacacaaactgcttatcctctaggatagcactttctagtataactttctgcaaggaagtaaattatcaatatctgtacttcccaatatgatagtccctagctgcatgtggactttgagcacttgtaatgtgattattgcaactgagcagctgaattttttcattctttttactttactttaattaattaaaacttatatttaaatagccacaggtgactagtggctattatattggcaagtgcagccctagaggctcatcaattagctgctattatacctctgattaaacttgaaattcctagaccatcaccctgtggtgtggctcttcctaggtaatgttttaaagtaaaagaggagataaactagttgagaccttctcaatattttaaaatgaataattattatctattttctatccatattggttcaaatttcagatacagtgcatgattgcactactgatgtcaccggtctgataaactgctgaatattctattttctgaatgcatacaggaaaagcaaataaaagaataatatgataaggttgtagagtatagcacctttacacatacatgcctcgttttccattcatgtgttagcactttacaatacactaaaccctgaatttgtgtctatatgtgtgtgtgtacacctccccgctacacacacttatactatattattatttacaaaaaatgaagtctttaaagtttaattatgatttaaaatatttttctactacaaaatgcttcatgctgtgtagattcatcaaacaatgtgcatttatctaagattctagctaaacaaatattctatggctgagagaacaagctcgatttaggctgtatgctacatagacctcttcccatttggcttctttttctttgccttatgcacataagattactggaaacatgatcaatttagacccatattttcaaataatctgacttatatgttttgttgtagctagaaaagtttcaatgtaagtacagctttttataaacacttctatttttcacagttaaggccatagttttgaatttaataattaccttatatatttttcctagtaggtggcttttaaatttgtacattgcaaaatgtagtagcaactgctactatagtattcctctaaaataataaaagttacactccacttgaattcataagacagagatcatttttatattatgaaactcttgcatatgactcacacaattctagtagtcttagaaactcaaacctacagaaattaaagcttatgcatttataaagaggatcactgatccctataggtggatgaggaagactgtttactaaattgtcttgattctcttcagtgaatattttattagcttccttcactcattcttaacaacacggtgctaaggtgaagaatgattgcttggaatttttatttagaaccttactgctggatttcctttatacccatttgaaacattttggtgtttgggtgttttagcttgtaggcttatgctaatttgtttggaacacatcataatgatctttgctattgcttttcacaaacctgaccataataagcattgtgttattagaatgggaaatgcggaagtgctaattagacaaaattttagcaaattaaaacattaaaatactgctttgggtcccacccataatatgctcctgctcctttttcaagttattatttttaactaagtggataaaaaggtcctttttttgtcttaaattccatgtttctgttgtaaggtccccatgattcataggtctctgtcctctacccacttatcctacaaagaaaatgcaacaaaaacaaataaccttctgggaaccctaacattttaaaatgagttttttaaaaaggtctaaattgcaaactaaagagtttctgactaaagcaacagaagtttgtctgatgccttgttaaattaatatttccccatagtgaatcactttattgttcttacactgattctaactaagaatatatatttctacgaagtaagggcttataaaaaatgtagttctctctagctttcttattggtaaagttgggattaaattagttagtgttaatgtagcaatagttgcttgtagtactgtttattgtgttacactctttattgtcatcaatttagttttactaaatattgtgctaaaacagtgataagtagttgatatggaaaagctcaaataaattattcagttaatgaggatttgctccattttctacattatctttacatacttaggactgtgttgggttacgtttatacttaatacaaaatttcttgaagacttaaagaggttactttattttcccaagccaactgcctaccctgctagcctcttagtcatgccttgttaaaaatgctgttcagtttctctcctctttactggaggaattccctcacaaagctagtatggtctggttctgacaaatgtgcatactttagtgttatgggctgaatcatgtacccctaaaattcagatattgaagccctaacccctagttactttgaactgtgactgtatttgtagctaaggcttttaaggaggttattaagtgcattttaaaataaagaatctaactctattgcttgtaactcaaaggataaatgattgaggggatgaatacctcattctccatgatgtacttatttcacattgcatgcctgtatcaaaacatatcaggtactccataaatatatacacctactctgtacccacaaaaattaaaaataataacaatttaaatggataaataaatccggcctagagtggactctaatccagtctgcttggagttcttataagaagaggaaacttgtgcataaaagagttaccaagcatgaactcgcacagaggaaagagcatgtgaggacataggggaaaacacagtcatctgcaaaccatagaggaaagcctaaggagaaactaaacctgccaaaaccatgatcttggacttctgacctccagaactgtgagaaactaaattcttgttgtttaagccatcctgtctgtggcagccttagctaactactgcatttggaggtagacagacagacagatagataggatgaggaaagtggatacccaagccttcaaaatagtggttaataaaaggctgactgtagcttagattagtcaaaatactttgctagttttaagggcaatgggtattactgcatcttgacaaagaggcataaaaaatgcaaatattggggccgctgaacattccagattgagtcataattaatgtttacacttaaaaatgatgagagatttaggtcaaaagacaaaaatgtgttcagagcattcatacctcctaatccaaatatctagaatgttccacactcctcagccgctcgattcatatacagttgccgttacattgcaggataatacttacatccacatttggtggaggtgggaggagatggaaactaccttttcttttttttattattatactttaagttctagggtacatgtgcacaacgtgcaagtttgttacatatgtatacatgtgccatgttggtgtgctgcacccattaactcgtcatacattaggtgtatctcctaatgctacccctcccccctccacccgccccaccttttctgtcattaacatagtagttaacaaaggtgtgagctgttggaaaaagtgtatccaaagttctcaccaaaacatacacaaaaccacattgaaatcctttgataagattttaaaaacatttctattcaagcttatttggaaaatgtgatacacaaaccatgagaatactacctaatgtaccatttcatattaaatgtagactaaacagttttaaatttataaaataaatattgatataatctcagctccaatattgctgtgttgctgttgctgctgtgatagtgcagtactatgttattatcatattgtataatttaatgtcttctaaatgtatcttcttttgtcaatattttgctcattttataaattacagttctgcaatggtgaggtaattcatatcttgaacatagtgctaaaatgatgtagtgcttccatttttgctcagcaattgatctttcaaatttttgcattttctggtattaatcatgtttattggcctaatgtttctataaagaattctcagtgttgcagtggttactttcatagtttattaaaatactcccttcccccaccatctctcttcattacagtataacaatgtcttattgattttaattgaaacttcaaatttgttaacactaaaatatgtcaatgcaccaaaccataaattacctccctgctcttaagcacatgctgtacaacagccaacatctggatgaaaagagagaacaagtggtaatcatagaagtattgcatgttttcaatgaacatagcagacctcaacatgatcaagggaatgatttctggtccattaaaccagtctatcaaattcaaccaaatttcctacatactaagctttcatgccatcttatctgaatggcttatagcaggaccccaacaagtaactgctaatttcttcccacgtttgattggaaaatctgtgtccatatcagcagggccagatacccttcaatctttacatatactgtgctagaatccagtgtttccttatctcagctcatctagttggaagctagtcaagactctcacttttggattacagattgactttggccacaaaagagcttgaaagaatactgaagaggaggactggagtaaggttcttcctcttcaggactggagtaaaagtggatgagcggacaggaagcttaaacaatcctttcagagattcttagcatgtaatttgcttgaataaatgttaaatcttgaggaggaatgccaattgggcctgaagacatttccctgaaaagtttacaactctcaaaactgcttttgcaaatgtggtttttgaaataaaagtataaaaatgtttgtcccctttgactcaaattccactcagggaattaattgattctaaggaaataatttaaatgaatgtttttgttataatgtagactataatagtgacaattggaagcaatgtccagtgtttgatagtcattacactttgtagatatgaagcaacatgacagactgcttataatgtaaaaatgggtatccatatgaacaaagtgtgggagggaactcaaagaagtgaaaataaacacaattttcaatgttgcggatatgagtatgttgatttttctacattaaaaaaaacattaaatatacgtattttacagagctcccaagagtcccaagcctaaaccccacacacagtgtcagagttttaggcagtaagtgggatggtgtcagccaggtagagtgctaatgttgcagtcccagcatgggaatggaggcagaaccactgacccctgaatgaatgaagcacatcaagcaaatagatgaagctgcctgcacaaccattttgttttctaaagccagactatgtgctcctgcagtgattggaatcccaccctttactcccctgtttaaagtattctcttgaaagaatgccctggaaattattctgtgtttgttttccatatggttttaagcaatggttctatcccccatagtatgctagataccagataaaatagctatgccaatgtagatcatgataatatagtattctgcatttatacacactttacctcactctctagcatgaaggatcaaggtaagtataatttcaaactggaagcaatggtttcctatttttgtccagcttattttacacaaaactctagtgtgtatgaatagatttgcttctctgagtgacctgagaagaaaagatcattttgtttcttaccatgtatttttgcatgttatcatgctcttacaaatgagtgtgttctttttcagtgatcagtacagtcctttaaaatatagtatatgtatgttaaaggtttagaatacaaggcagtggtggtcaattaatgttcctcaacatgtaagtgcttctaaaagctattcattatgattccagatttgttgagactaccaacaagtcaagagtgcctatactattattgagaatgatttggccttcccagaggcagcttacatctctagactattgaaagtttttgaaactgtcataaaaatgagttaactgtgttcaataataatttcctaagaggtagtattcatgattacagccctaaaagggaattttaaaaagccttcttatgaaagttgtcaagttgaaatatgtttatatgaatatttttcaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagtatgtatactgtcctcacaaaactgggtgtgttgaacaaaatactatccaagacctactagaaacctttggctggcagggcttagtctatttttcttcaataaagtttaacaatttaatatcagaaggggaggtaaagaaggactcactttccctctttacctccccttctgatattaaatggttaaatcttaaatacatataagggtacatgggaggtacgtggaaagtagaggtacataagtagaggtacatgggaggttatgtagcacagtagttaagaatattggctaaagtcacacaaacttgtgtttgaattccacatgttttgaattctttttttttttttaaatggagttttgctcttgttgcccaggctggagtgcaatggcgtgatcgcggctcattgcaacctccgcctcctggttcaagcaattctcctgcctcagcctcccaagtagctgggattacaggcatctgccaccacgtccagctaaatttttttgtatttttaataaagacggggtttcaccatgctggccaggctggtcttgaactcctaacctcaggtgatccactcgcctaggcctcccaaagtgctgggattacaggtgtgagccaccacacccggccacatgttttgaattctacatcattgttagacgttggagaagtcacctaacctttccaagtcttaatatccacaactatagactgtggataaaaatacatccacttaaggttaccgtgagatctcaggataataaaataaaatatgttaacagtgaattgcatatagtaagtactatatatatcacaagtagtattattacttagcaatcacactatagctaatgtatacaaattcaggtttacatgatgttttagggacttcaaagactcacaagtctttctgcagcaaagcagatcttgtgtatattacttttgtatatatcttacttttcttacaaatggataatccaggatagggtttcattactctcttccctgacacttttattctcccattctaccttaggatgaaggcaacagaggaattctaagacattttaatatgatgttccaaatcttagtgaaattggtcagttattaagcatacaaaaataagttatggtgtgatactttaaagtggttataatctcaagcataaaatgtcccatacaaaatgaaatgttaagcaaaagcaaatgaaaggaatgccagaaaagttataaatattatgttatgaaaagttaaaaaaggactgattaaagtagattcaggttataaagagggtaatttagaagactttggcctctagtctgacatgtaaagagcttggaagtcattactcccatccttgcaactagaaaaaagataaacaaactgaaaatctaacttattaaagccatcagagtttgaggtcacagagctccaccatgctggaaactagagagaaaggcagcacagctcataaggagaagaagccacagctagatcctggtagaagcatttaaaagataattgagtaattgcaggagactcactgtagatctagctcgagagacaaaaactcatgggggccctgtcttatggggcccctacactttcatgagttttatttctaggagccataccagattctcagggtgaagatatgataaaattcccctcatgtttctagtaaggggaaaggaaaagtaacaactttgaaacatgctcatagtgctctgttctcctgaaggcctgtcctcaaagaaaactgttttaccagagggtaaactacttggttttgctagagcctaactgacctggggaaagggatatactaacctccaacaccctctaacttttatgtgaggggaaaagaacagtacaattccagcagccttaagcctcctgtctcacctaaggacttatgggagctaaaaatcacttgtgaaagtcacagcccaaggatacaggctcactaagggactaagacctaatcataagattatagaatgtttgtttgctcacatttaactatcgccacagtagtgctcctgtataacaaagggggattacagcttaaagagctggaattttcagaccctatttatgacaggttctctagggagaagcaaaaacaaggaggagagaaacaagactagaggaaaatgtagacactaatgccacaggtcgagcaaccatttatgatagcctaactcccagccagatcagcataaaacctatcaccaaaggcctatttacttcagtctctcctattacatcatttctggctttaaacgaaaaaaaatgcaaacataaacaaaatcaagtaacacaatctgaagagacagagcaaacaacagaaccaaattcagacatagctgatattttagaattatcagactgagaacttaaaaaaacaactaatatactaagagaatggaaaaaatgaacatcatgaagaacacgtgagatagctaatcagaaaggtagaaaccctaagaaaaaatcaaaagaaaatgctagggataaaaaaaaaagaactccaacaaaatgaagagtatcttatatgaaatcatcaatagaatacacagagccaaggaaagaatcagtaagcttgaagatgtttcaacacatacttcccaagctgaaaaaagagaaacgttgactgaaataaaataacagaatagactaagaactgtgtgacaaagagaagaaaaagatgaaagaacagaagacatatttgaaataacaatgactgagagttttccaaaattaatgagaaacaccaaaccacaaattgttcagcaaacactaagtaggataaataccaaaatctacaaatacccatatcatattccaactgcagaaaaccaatcacaaaaagaaaatctggaaagaagacagagaaaaaaatttattttcatacagaaacaaagataataattacactggatttctctttagaaaccaggcaaacaggaagagagtagaatgaaatatttagagtgttgaaaaagaaaacaccataaatgtatacccctactatctaaccacaagaattaaaaatatgtatatttaaaaccccacaaacctagaattctgtctccaggaaaatttccctttaaaagtgaaggagaaataaaaactttctcaaacaaaaattgaggtaatttgttaccataccagtagacctgcatcgcaagaaacattgaaacatcttcagaaaaaaagaaaattgtatactttggaaagtttgatttatgtaacgaaaggaagagcactagaggaggaataaatttagataaattaatttttttaatttcttctttttgttttgttagttttgtgtttttttttttttttttttttttttttacagggtctcactctgtcacccaggctggagtgtagtggtgtgatcatggctcactgcagccttgacctcccaggctcaggtgagcctctcaactaaccccctccatcccccagtagctgggactacaagcatgtgccaccactcctagctaatctttgtattttttagtagaaacagggttttgccatgctgcctaggctggtcttgaattcctggtctcaagagacctgcctgtcttggcctcccagagtgctgggaatacaggcatgagccaccgtgcccagccaatttataaaaattcttaatctaacacataatggtctgttcaaacaataaaaacaacataagcaggagtagcaattcttatatcagataaaacagactgtaaagcaaaagcagtgaagaaaagacaaagaaggtcattatattaatatattgataaaaggatacatccaacaagaagatattacattcctaaatatacctgcacctaactctgaagctcccagattcataaaacagttactactagacctaggaaaagaggtagacagcagcacaatcatagtgagcgtcttcaacactccaatgacagaactagacagagcatcaaagcagaaagtgaacaaggacttaaactgaactctagaacaaacggacctaaaagtatttacagaacattttacccaataaatgcagaatttacattcttctcgtcagcacatggcacattttctaagatagaccatggattagtccattttcacactgctagtaaagacatacccaaggctgggcaatttacaaaagaaagagatttactggacttacacttccacatggttaaagagacctcacaatcatggtggaaggcgaaaggctcttcttacatggcggtggcaagagagagaatgagaaccaagtgaaggggcttatccttataaaaccatcagatctcgtgagacttattcgccaccatgagaacagtatgggagaaaccactcccatgattcaattatctcccactgggtccctcccaaaacatatgggaattatgggaatacaattcaatatgcgatttggatggggaaacagagccaaaccatatcagcccatatgataggccaaaaaacatgtacaatttattttatttcagttcagctcagattttgattatttttgtcttctgacatgtttggggttggtttgctcatgcttctccagtttctctagttgtgagattaggttgttaatttgagatcttccaaactattttatgtaggcatataatgctataaacttcaatactaacactgacttagctgtgtcccaaagattttcatatgtactatctttggtctcattagtctcaaataatttcttgatttctgccttaattttattatttacccaaaagtcatttgggagcaggttgtttaatttccatgtaattatatgattgaattttttagtattgatttctgtttttactatcgtgctgtccaagtgtggctggtataatttcacttttttcaatttgctgaagattgttttatgtttgattatgtggtcaattttagtatgatttcttttttttctcaattttctgagatttttttatatttgattaggtggtcaattttaaagcatgtgcatgtgcagacgggaagaatgtgtattctgttgtctttggttggagagttctgtaaatgtgtattaggcccatttggtcaagtgtgagttcaggtcttgaatatctttgttaattttatgttttgatgatttgtccaatactgtcagtataatgttgaagtctctcactattattgtgtataaatccaagtttcatcatagttctctaagaacttgctttatgaatctgggtgctcctctgttgggtgcatatttatttaggatagttaggtcttcttggtgaattaaaccctttattattatgtaatgctcttttttatctaaccccagttaaaaaaaaaaaggaatccatgattttgttctttgaaaaaaataataagataacataaaccactaactagactaacaaagatacaaaagagagaaaatccaaataaacacaattacaaatgacaaaggggacattaccactaacccacagaaatacaaaaaaaatcctcagagacttactataaatacctctgtgcacacaaactggaaaatttagaagaaattgatatattcctgaaaatatacaaccacccaagactgaacaaaaaagaaatgggatatctgaacagaccaataatgagttccaaaattgaagcagtaataaaaagtctaccaaacaagaaaagccagggactaaatggattcacagctgaattatattagatgcacaaagaagggctggtaccatttatacagaaaatgttccaaaaaattgaggaggagggacctttctaacttgttctgtgaggtcaggatcatcctgataccaaatccttgcagatgcacaccaaaaccagtaaaaggtaaaaagaaaagttcaggacaatatccttgatgaacacagttggaaaaatcttcaagaaaatactagcaaaccaaattgagcaacacgtagaaagctaatccaccatgatcaagtatgctttatccctggcatccaagactgtttcaatatatgcaaataaatacatgtgattcatcatataaagagaagtaaaaacaaaaaccacatggttatctcaatagatgcacaaaaggcttttggtaaaattgaagatcccttcatgttaaaaaccctcagtaaactaggcattgaaggagctaccgcaaaataataagagccatctctgacaaacccacagccaacatcacactgaactggcaaaagctggaaacattccctttgaaaaccagcacaaggcaaggatgccttatctcaccactcttattcaacatagtactggaagtcctggccagagcaatcaggcagggggaagaaatcaaaggcatccaaaaagtaagagaggatgtcaaactatccctaattgcagatgacataattctacatcatgaaattaacccaaatgcccgtcaacagtagactagataaaggaagtgttgtacatatacaccatggaatactacacagccataaaacagaattagatcctgttctctgcaacagcatggatggagctggaggccattaccctaagaaactaatgcacgaacagaaaaccaaatacaacttattctcactcaaaagtgggagctaaaccatgaacacacatggatacaaagaggaaaacaacagacacttgggcctactggagggtggagggtacaaggagggagatgatcagaaaaaatacctattgggtactatgcttattacttgtatgaggaaatagtctatacaccaaacccacatgacacacagtttacctatataacaaatctacacatatacacctgaacctaaaataaaagttaaaaaagtctcaataagttttttaaaaatcaaaattatatgaaatatcttatcaggccacagtggaataaaactagaaatcaactgccaaaggaaccctcaacgctatagaagaacatggaaattaaacaatctgctcttgaaagatttttggtttgacaataaaatcaagatggaaattttaaaaatattcaaaatgaatgataatggtgacacaagttattaaaacagctgggatatagaaagaaaaatagtgtcaagaggaaggtttatggtgctagatgcctacattgaaaagtctgaaaggtcacaaattaacaacctaacatcacacctcaaggaactagagcaactagcccaaaccaagcccaaagctagcaggggaaaagaaataacaaggattagagcagaactaaataaaattgaaacaaaatctatgaaaaagatcagttaaagaaaaagttggttctgtgaaaagataaacaaaatctatagaacattaggtagattaatcaagaaaagaagagagatgattcaaataagctcaattagaaataaaaatggagctattacaaccaacaccacagaaattcaaaagattatttgagactactatgaccacctctatgcacacaaactagaaaacctagaggaaatgaatgaattcctggaaacatacaaccctcctagcttgaatcaggaagaactagaaatcctaaacagaccaataacaggcaatgagattgaatcactaatttaaaaattgccagtcaaacaaaagcccagggctagatggattgaaagccaaattcactggaccttcaaagaagtggtaccaatcctactgaaacttttccaaaatattgagaatgaatcccctccaactcattctatgaagccagtatcaccttgttacccaagcaagaaaggcacataaccaaaaaaagataactacagaccaatatccctgatgaacctaaatgaaaaaatcctcaataaattacaagaaaaccaaatccaacaacacatcaaaaagataatacaccatgatcaagtgggtttcatcccagtgatacagtgatgggtcaatgtactcaagtccagaaacgtgattcaccacctaaacatcatttaaaacctaaagcatatgatcatctcaataaatgcagaaaaaaattcaatgaaatcaagcattcctttattataaaaaccctcaacaaattagacattgaagaaacataatttaaaattataaaagccatatatgacaaaccaacagccagcatcatactggaaggtcatacactggtggcattttccccataagaactggaacgagagaaggttgcccatttttaccactcctatacaacatagtattggaagtcctagccagaacaatcaggcaagagaaagaaagaaaagacatacaaataggaaaagaggacgttaaaatatctctcttcactaacaatatgattgtatacgtagaaaaccctatagactctatcaaaggatttcaagacatgttaaatgacttcagtaatgtttcaggatacaaaatcaacatacaaaaaaattgtagcatttctatacacccataagattcaagctgagagccaaatcaagaatgcaatcccatttaggatagtcataaaaatgtaaaatatctaggaatacatctaaacaatgagtcgaaagatctctacctaggaatacatctaaccaatgagtcgaaagatctctacaaggagaactacaaaacactcctgaaagaaataatagatgacacaaacaaatggaaaaacattccatgctcatggattggaagaatcaatattgtcaaaatggccataccgcccaaagccatctacagacttattacaatttctatcaaactaccaatgccattattaacaaaaaaactatcataaaattcatatggaagaaaaaaattggcctgaatagccaaagcattcctaaacaaaatgaacaaagctggagagccatcacattgctggatttctaattatgctacaaggatatagtaaccaaaaccaaaacagcatggtacttatatgaatatagacatatagaccaatgaaacagaatagagaacccagaaataaagctaatttttgacaaagcatccaaaagcataaattgggggaaagggaaccctattcaacaaatggtgcttggaaaattggataaccatgtgtagaagaatgaaactagatccttgtctttcaccatatacaaaaataaacttgagatggattaaagacttaaatctaagacctcgattaataaaaattctagaagaaaacatagaaaaatctcttataaacattgacctaaacaaagagcttgtgattaagaccgaaaaagcaaatgtaataaaaataaataaataaatggggcctaattaaaccaaaaaaaaccttctgcacagcaaaagtaataatcttcagagtaaacagccaactcacagaatggcagaaaatgtttgcaaactctgcatctaacaaaggactaatatccagattctacaaagaactcaaacaaatcagcaaggcaaaaacaataccatcaaaaatgtgggcaagtgacattagtagacacttatcaaaagaagatatacaggaaatgcaaatcaaaatcacagtgcaataccaccttactcctgcaagaatggccatagtcaataaatcaaaacataatagatattggtgtggatgcagtgaaaagggaacacttctacactgctggtgggaatgtaaactagtgcaaccagtatggaaaacaatgtggagattccttaaagaactaaaagtagaaccaccatttgatctagcaatcccactactgggtatgtacccagaggaaaagaagtcattatacaaaaaagataaatgcacatttatagcagcacaattcacaattgcaaaaatatggaaccagcccaaatactcatcaatcaacaagtggatacagaaattgttatatatatatatatatctcacatatatatatatatatctcacatatatatgtgagatatatataatggaatactactcagccatataaaggaacaaattaattgcatccacagcagcctagatggaactggagattattcttctaagtgaagtaactcaggaatggaaaaccaaacatagtgtgttcccactcataagcgagaggtaagctatgaggatgcaaaggcataagaatgatacagtggactttggggactccggaaaatttgggaggtgggagagggataaaagactataaaatgggttcagtgcatacttcttggatgatgggtgcaacaaaatctcagaaattaccaaaaaagaacttaatcatgtaaccaaatgccacctgttgtccaaaaactcatggaaacaagaaataagaaaaaagatatacaaatgaccaagagcatatgagaaaatgctcaacatcactaatcaatagggaaatgcaaattaaaaccacaacgagatggtaccttaccccagccagaatggatattattaaaatttttaaaaaatatagatgctggcctgggtgtaatgaaagaggaatgcttatacactgctgatgggaatgtaatttagtacagcctctatggaaaacaatatggagatttctcaaagaactaaaagtagatctaccattcaatccagcaatccctctactgtgtatctatccaaaggaaaagaagtcattatatcagaaagacacctgcgcttgtatgcttaccacagcacaattcacaattgcaaacatatggaatcgacctaagtgttcatcaactgatgagtagataaagataacgtgttatatgtatacaccatggaatactactcagccacaaaaagaataaattaatatcttttgcagtcacttggatggagctgaaggccatcattctaagtgaagtaactcaggaatggaaaaccaagtattgtatattctcacttaaaagtgggatttaagctatgtgtatgaaaagaaatacagagtggtataatggacattgtagaatcagaagggaggagtgtggcggggtgggtgagggacaaaaaaactacattatgggtacagtgtacacttctcaggtgacaggtgcactaaaatctgagatttcacactatacaattcatccatgtaaccaaaagttacttgtactctcgaagctattaaaatacgaaaaataacaagaaaaagtaattttaaaaagaatgtattggatgattataccttgtggataagtgaaataaatgagagcaatgttataaaggactgaaaggaggaattgagaattgagaatactctgttataaggtatttttagtacccttaaagtagtatagtggtatttgtaaatggaataagactaattgtaaatatatattgaaagctgtaaggcaaacactaaaaaacattaagagttttaatagtttaatttttaaaatattaaaaattttaattaaaattttaaattcttcttaaattcatgtggaacattcaccaagataggacacattctgggccataaaatacactttaacacatttaaaagaatagaaatcagacaaagtatgctctcagtcataatggaattaaacgagaagccaataacagaaagacagctgtaaagtcaaaaaatacttggagattaaacagtacacttataaataccacacaagtcaaaaaagaacccccaagaaaaattcaaaagtattttaaagtaaatgacaataaaaatataatttatcaaatttcataggatgtaacaaaagcagtgcttagagggaaatatatagcattgaattaattaatatattaaaaaggataaagagataaaatcagtaaccaaagcttccaccttaggaaaataaaaagataaaaaattaaatctaaagcagaagaaaatatataataattattagtatagaaatgaatgaaattggaaacagaaaatcaacagagaaaatcaatgaaaccaaaagctggttcattgacaagacaaatgaaattcataaacccctaggcaggctaactaagaaaaagagagaagatgcaaattactatcatcagaaaatagaagccatcactatttatcctatgacattaaaatgataatatagcaatactcaacaactctatacccacaaatttgataacttggatgaaattactcaattttttgaaagatacaatctaccaatactcacacaagaagaaacagataatctgaaaaggcctatacatattacagaaataaaatctataattaaaacccttccacaacagaaagcaccatgttcaaatgggttcacaggtaaagtctaccaaacatttaaagaagaaaatataccaattctctgcaatctcttccagaagatagaagcagagggaatactttctaactcattctatgagatcagaattacctaaataccaaaataccagagaaagataacataggaaagggaaactacagatcagtatctctgatgaacataatgcaaaaatcctgaaaacagaatagtacattaaagttaacaatgtttaggaaaaattacacaccgcccaggcgcggtggcccacgcctgtaatcccagcattttgagaggctgaggccggtggatcacgaggtgaagagatcgagaccatcctggccaacatgctgaaaccccgtctctactaaaagtacaaaaattagctgtgtgtggtggcgtgcgcctgtagtctcagctacttgggaggctgaagcaggagaatcgcttgaaccagggaggtggaggttgcagtgagccgagatcacaccactgtattccagcctggtgacagagtaagactccatctaaaaaaaaaaaaaaaaaattacacaccatgaccaagtggaatttattccaagtatgcaacggtagctcaacattggaaaatcaattgatgtaatctattacatcagtaggctagagaataaaaataatatgatactaaaagtagatgcagaaaaagtttttgagaaaatacaatacccattcataataaaaactcttagaaaaaaataggaaaagagggggactgcctcaacttgttaaagaacatctataaaaacctactgctgacatcttactcaatggtgaaaaactagatgcttttcccctaagatcgaaaacaagggaaggacgttacctcttatcacttctattcatcgttatactggaggccttagttggtaaaaaatgacaagaaaaatgaaataaaatttataccaattagggaagaaaaaactgtattggttcaaagatgactgattatctttgtaaaatttcaaaagattttacaaaaaattctcatagaactaataagagattatagtaaggttgcaggatacaaaattaatgtacaaaatcaactgctttcttgtataccaacaatgaacagttgcaatttgaaattaaaaattcatcttaagtgaaacaactctgaaacagaaagtcaaaaacttataagtgggaactaaatcatatgtacacatggacatagtgtagaataatagacattggagatttggaagggtgggagggtgggaagggagtgggggaggaggaagtacttaatgggtacagagcacattgtttgggtgatgattacactaaaaacctagatttcaccactacacaatatatccatgtaacaaaactgcacttctacctcttaaatttgtacaaataaaaacacaaaattgtttaaattagcaacaataattgaaatactcaggagtaaacatagcaaaatatatataagatgattagaaggactactgcagaactctgatgaaaaaatccaggaatatataaataaatggagagatatcttacgttcatggataggaagactcaatatgattagaacagcaattcttcccacttgatctatagattcaatatattccccatcaaaatccaaggaagttgttttgtggatactcacatagtgattccaacatttatatggaaagtaaaagacccacaatagccagcaaagtattgaacaagaaaaaatgtagtggactgacactaccatacttcattatttactgtaaagttatagtaatcatggtagtgtgattttggcaaaagaactgacaagtagattagtattaatagaacagaatagagagcctagaaatagatccacacaaatgtagtcaattggtatttgatggaagagcaaagacaattcaatagaaagatcatagcatttttctacaaattacagtggaacaattgggatatcacatgcaaagaatgaacctagacacagaccatctgcccttcacaaaaattaactcaaaaggatcatagtcctaaatgtaaattgcaaaactctgaatctattagaagataacatcagagaaaagctaggtgatcttgggtttgacaatgtggttttagatacaatatcaaaagcataaaccttaaaataaactaataagttggatttcattaaacttaaaaaccgttcatgacacacactgttaagagaatgaaaaaacaaacaacagagtaggaaaaagtctttgcacaactcatatatgataaaggaccaatagatatacaaagaacttttaatctcaacaataagaaataagcaaccaaattaaaaagtggacaaaagtcgtaaacagacatctcattaattaaggcatagttggataataagcatatgaaaacatgttgaatataatatgtcactagggaattgcaaattaaaacaactaggagatacccatacacacctgttgaaataactaaaatccaaaattgtcaacttcaattgttcacaaagatttggaacaacaggaactttcagtttggttttaatggaaatgcaaaatactatagtgactttggaagacattttgggcatttttttaactaaagtaaacatagtcctgtatttatacaaatcaatggagaacttaagttcacacaaaaacctatacaccaaagtttatagtaactttgttcataattactaaaaattagaaacaaccaagatatcctttaatagatgaatgcataaaacaactgtggtatatatgtactatggaaacatatttagcaataaatacaaatgagctatcaaaccttgaaaagacttgggtgaaccttaagcggaaattgctaagtgaaacaaatcagtctgaaaaggctaaatagtgtgtgattctaactaggtagcattcaggtaaaggcaaatctatacagcctaaaaagaccagtggttgccagaggatggggagagggataaaacaagtgacctctgctgtaaactgtggactgtggttaatacatcaatattgatttttcaaatgtagatatataacagattattacaagatagtaatatgagggccaactgtgtgatggcagagtggagatataaggaaattctctgtaacttctgctaatgtgttttattaatctaagactgctctaaaactagtctatttatttttttaaaggaaggggtatttatataggcaaatcaattgggttaggaaggcagattccagagagaagcattaacatgagtgaaggctaacgtgaattcaaactgtagatgtaaatagtccagtggggctagagtacagcatacagagaggaatataatgaaacattacaaccagaaaggtaattttggatgaaataaaaatgcttgtattttattctggtagcagtaagtagtcactggaagtcttaaaaagggagtggaaaagcaaatgaaaagccacagtaagacagattgggaagatagggtacttgtatcaagggattaatgcctggtagtcactgtagaaatgacaaaatattacagaagtcaacgtgacttagaaatcaaatcaatgtgggatttagatagaggattactaaagtttgtacctttcatggctagaaggaggtggtgctatgcacttacataaaaattataggagttgctgaaataccaagatgcattagaaattattcttacaggcccagctctgtggctcacgcctgtaatcccaggactttgggagaccgaggcaggcagatcacttgaggtcaggagttcgagaccagcttggccaacatggtgaaactccatctgtactaaaaataaaaaaaattagctgggcatggtggcacatgcctgtaatgccagctactcgggagggtgaggcaggagaatcgcttgagcccgggaggcggaggttgcgtgagccgagatctctccactgcacttcagcctggatgacagagtgagactccgtctcattaaaaaaataaataaataaaaaataaaaaagtaaattaaattaaaaaaagaattattcttttagtaacttgcataatgtccgcgaagtcaataggaaaagagataacccattttggtgatttttaaaaaagatttgtctttattaccatgctattaaaaggctacctgtatatctagcatgtgactaagtgagccaggttgcgggtgtggtgtgtactactgatggtttttaattttatgtgttcagtttcagaaaacgtttgactttcataattcagtatttgcgtatgctttgcatggagaactcatgtgtggtcactgttaaactggcctgttatgtaagtactagcttggggtaaagtctagggcattacggtcaattgacagctattgcaggtcatgatttcaaagtatgagttttaagcctttcatggtcatttgaaatgtttgatgaattagattttaaaactgccaatgggctgttaaattctttttgtagtttgcatttagtttgcatgtcaattggactttaagtaggcatatttcttattatcgccagatggtgtctaggtgatgctgaaaatctttggagaatgaggaaagattattacactgttaagggaactgtaaattgaacaaaagcttatttaagcatttgaatagtaaataggagcactgatggctacttttcatctaagtttgatcaatttgtgactgaagcagtgtaaacaaagaaggactgaagtgtataattaccttgggcttgtggtaaatgatagccttatatagaaacctacttaggtcattgattgtcgttattatattgagcataatgtgaaggtttcaggagaaagataaacagtgattagtttaatatatattataaaatatcattatagcataagctatatgataatttcagtataaaagtgcatatgtacctaagtaattttagaaggctaactgaaaatatgcttctagttttaaaggaagtgagttccacatacaaatgagattgtacagcatttgtctttctgtgcctggcttattttgcttagcataatgttctccagaatgacaagtgtttgaggtaatggatatattaattagctttatttaattatcccacgttgtgtgtatatatatatgtgtgtatatatgtgtgtgtacacatatataatatataatgggatcattttgtattccataagtatatacaattgtaatttgtcaatttacaataaaaattgtaactattaaaagtaaaaataaccaaaagtgagtggaaaaggccattttgaattcaatgttgtaagagttgttttgaggcctcattgataaattaataattgcaagaaaaatgtttcagagctcataagtttagtttggaaagttgttcctaaaaaggatttacagatagtgagccataagtgaacacggataggagaaaagtttaaaatattttctgactccaggatatggagtcagatagggagtacagagaatgtttcctttcctgagttccacgcagaatttaagtttctaggttaggttttatccttatgtaattctgataacactgcattttgtgactatctttatcagaaacactggtggataatgttttctttatttaggaattcctttcattgtgataatcacttgagtgttgtatgagaccttacctacctggaaatgtaatccattgattgtgctgcctttgtactttcttgttaacagttttagatcaaccattataattgaaatcaggagacggacctcaaataaattaacactgcttcttccttctagctcccattaaaattggactttattaaaattaaaaactactctgtgaaacacattaagaaaatgaaaagaagccatagaatgcgagaaaatctttgtcctaaaaatatatgtgttttgagtgtttgtattactgccactttgttttgaggaatgagatttagggagctttttaatatacttcctatagattcactgatgttctttttctgttgtgataagggaaacaaggaaaagtgaagcgattaccaagagtaaaaaaggacgttattaatacttaatacttgtgcgcagaatcaacataaatgctgtccaccatagaatttctgtagtctgtgataatttagaaaaattataagcagggatattttagaatatctattaaagactactgatttctgggcttctgtccaaaattaggcaagattactgtagaggtaattgtttgtaataagtgctacggtttgctcacagtcacgttcacatccatgaagctagactaaattttagtagactctgctcaaactcctttcctcctacaaatttcagcctattaagggataagtagacaacgattttaatgttaccttttacatgatggcaaacctgtggctgccagaagttgaatgtggataataattgagatatattctttcagatatttcaaatgtgtgaaaattatttcaacttgcataagaaaaaaatgaaattcctgaaatgacctaacaatatttgttattaagtatttcttattaaactagaaaatacgttgatattttgataggggagttattatttattgacaaagactttaaattaaagctattaatataagcattcattttagagatttatatctaaaagggtataacatactccaagtcttgttttcttctacagttctgaagcttagagaatctacatcctgccttatcagcacctctattaagtgtcttaaagaaattgtaaagctgtcaactatcaacacatcaatgcattattgttatgatgttacaaaatggttataatgattaagaagaaagttcttagttttgaaatgcaatgatgtttggcttaaagatttgtgtttgttttatgggtaaaaattttgcatcttataaatatttgggaagtgaaagcaaaaacaaagcatatttataattaaatgtgtggatacaggaagatttttaaaatgattaaacaatataaaataacacaggtactattaatggcacaaggagacactaagatataataaaaattgtttttataagaaaactaagaatgaatttaggtactttttaacaaactatttcagataatcataatgtaacaagtttaatatgcactgtctcttttaggactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggtaagaatcgtgatttagaaaaggacaaaggtgtcaatttcatgcaaattttgataaaatatttacaatcccactggatcttcagtagtaactcagctcattgactcagttagttagcatacagtattgatgggtttagtttgtgactaggcctgccaggtttgttgttgtttgtttgttttcattctatgaccacagatctcacttttaattctatttcctgtcttgcaatcatgtgcacagtgtgggggaggcatgggcagactaatgacagagtagaagagtgtgcaaaaaccattcccatagctggggtgaaacaaagtaaacactgtgcatctttttggagtttgagagacagttatgaggtatgatataacatacaggacttatagtcagacagatttgggttccaattctgatttgcaacttagctgaatgaacttgggtatgacagccctcctgaacatgtttcctcaactataaaatgaaggtcatagttaataatctatgctgcttatttcatgggctgtctggagataatatgagtaaaatatatgtaaaaacctgtaaaacattaacaatatttatgataatatattgcattaacattataatgttagaatactatttttcaagtttatgggcattggataatgaaacacaaaggatatttcgtagctaccccttctttttcctcttagtttggcatatggcttttctgctctctttccaattatcatatgaactagggttttgaatgctttttcttcttgtgaggaggtgatatatgggtacataggatcccaagattttagtcagaaacccattgatttcctcctttattccttcacttactcaacaaatattatacccttaataattacatgccaggttattgagcaatatgggaaatttataagtaagatatacaccttgacttccaggagctcccaaacataaatgtgagacaaacaagtacccacttaatttgtactaacaagacagactatgatggataacataggagaaccaccaagtattacaggaatttagaggaaggagtgattttatctacctttaagaagagaggaggcagggatctgggaaggcattatagttgatggatttcaactgagccttgcaatattgatatgattgtaatagataggcatggaagtgaaagaactgaaggcagaggaaatgtgacattttggacatatttgtttcattttaaaatcagcttgtaattttggagccttctaaagcactgaagaaaatttaaagcataacctttgtaagaaaggaacagaaaaattgatcatttttataaagcttcatctatatatttaaaacaccaagtggaagcatgcttcctggaaagactggttacagacttcaccgctacacaaattccctggcaacaaaactgcacttgtatccctgaatcaataaaaaaaattaaagggtaaaaataaagcctgtggttgataatggattagtctatcctaactaatgagagctctgttattaaaatatttgatgggagtgtaaacttggagttagagttgtctttgagaagaaaattacccatgaaatgtgggataaatttcccattattttgaaactggatggctattaagaaaatatgacaacacaaacaaattgtgaaattatattaaaaagcaaacctgggagcagtggcagtgacatgtgcctgtagtcccagctgcttaggcgcctaaggagaggaagatcacttgaaaccaggggttcaagatcagcctgagcaacattgtgagactccttctctaaaacaaacagacaaacaaaagcacttcaaagtaatggtattgttatactggctttggaatgatggaagagtactcttaatagaggcatgcatatgactcttaaaagtacattggtttgttttcataaataccatatttaattagctatattttgtttgaatgtttgagacttcagttagctttgtgaataatttgagtcaagaggcacatggaaatgtggttcataattgtggtcctggaaatggaaaagataattatcttcttaatccaaatattgttttattttttacccattatgacaatataactgaaattttgtttagggcttattagtctatttcatatgcaaccttttaaaaaagaaacttggaattgtcacaaacaattttatacaactttttaaaaggcgaaattagatcacatgcttatttatgtcctgccaaatacacaaatacacagaaaccattttatgctaaagagaaatggatctactttcatgtggttattttgactaaagtaagttaagagagatatatttaattaaaacactctgataaaaatttctatttctctacaaatctatcagaaatatattttgtcatatgcatagattgcatggtggtggaaaaagggctttttgggtatccattatccaaataatgtacattgtacccagtgagtaatctctcatcatgcaccctattccatcccctcacctttccattgtttatcattccacactttacactcctgtgtacacattatttagttcccacttataagtgagaacatatggtatttgtctttctgtgcctgacttgttatgcttaagataatggcctccattttcatccatattgctgcaaaagacagatttcattctttcttatggctaaatagtattccatttacatatatagatatatagtattcatatacacatgtatgtatatgtagatagatagataggaacttgataatgagttagtctatcctaactaatgagaggtctgttattaaaatatttgactggagtgtaaacttggacatagaattgtctttgagaagaaaattacccatgaaatgtaggataaatttcccatgattttgaaactggatggctattaagaaaatatgacaacacaaacaaatgatgaaattatattaaaaagcaaacctgggagcagtggcggtgacatgtgccttattatatataatatatatatatatatacatatatatgaatactatttggaatatatatatataatggaatactatgatcctaaaaaagtgcaagatatatatttttatatatattcatatatatgcatatgtatatatatatcttgcagtttttctttatcatatcatctgttgatggacacataggttgatcgtatatcattgctgttgtgaatagtactgcaataaacatatgagtacagatatctttttgatatagtgagttattttcctttgggtagatactcaatagtgggattgttggattgagtggtagttctatttatagttctttgagaaatctccatactgtcatagtgaatgcactaatttacatttttaccaacagtgcataagcattatgttttctcctcacaaacacttgttattttttcttttgaaaaatagccattccgactcatgtaaaatgatatcccattgtggttttaatttgcgtttctctgataattagtgatgttgagcattttcatgtgcctgttagccatttgtatgtttatccatgtcctttgcccactttgtactgggattattttgagttttctttttgagttgtttgagttccttctaaattctgattactaatcccctgtcacatgcattatttgcaaatattatctcccattctataggttgcctgttcaatcttgattatttcttttgctgtgcaaaagatttttagtttaattaagtcccatttgtctatttttgtttttgctgcctgtgctttttacatcttattcataaatactttgcctagaccaatgtccaggagaattttccttaggtatttttatagtatttttataatttcatgtcttgcatttaagggtttaatccatgttgagttgatttttgaatatgctgaaagataagggtccaatttcattcttctgtgtatggcaatcaaagtttcccagcaccatttgttgaaaagggtgtcatttccccagtatatgttcctgttgattttgtcacaaaagagctggctctgagtgcatggctttatttctgtgttccctgttttgttcccttgatctatgtgtctatttttatatcagtaccatgctgctttggttactgtagccttacagtataatttgaagtcaggtaatgagatgcctccagccttattctttttgcttagtatttatttggttatttgtgctcttttttagttccatatgattttgaggatagtattttctatttctgtgaaaaatgaatttttttatggattgcgttaaatctgtagattgctttgcacagtatggtcattttaataatgttagttttttctaatccaagagcaagggatatttttccatttgtttttgacatctacaattactttcaccagtgttttgtagttttccttgtagatatcttttacctctttggctaaaattattcttagtttatttttcactagctgttgtaaatgggattgttgtctttatttgtttatctgctggatcattattggtatgtataaatgctaccaattttttgtaaagggatcttcaaactttactaaactaatttctcaaattcaaaagatatttggtggagactgaggttttctagatgtaggtcatatcatcagtgaactgggaaaatttgacttccccttttcaatttggatgccttttatttctttcttttgcatgattgctctggctgggtgtattagttcattctcaagctgctatgaagaaatacctgagactgggtaatttattaaaaaaagatgtttaattgactcacagttccacatggctggggatacctcaggaaacttacaaccatggcaggaggcaactgttcacagggcagcaggagagagaatgaccgccaacaggggaaatgccagacatttataaaaaccatcagatctcatgagactcactctttcacaataacagcatggaggaaaccactcccatgattcaattacctctacctggtcttttccttgacatgtggggattataacaattcaaggtgagatttgggtggggacacagaggcaaaccatatcatttcaccactgcccctccaaaatctcatgtcctcacatttccaaacacaatcataccctttcaatagtccctccaaatctttttttttcttttttcttttttttttcttttttttttttttagatggagtctctctctgtcgcccagcctagagtgcagtggtgctatcttggctcactgcaagctccacctcccgggttcacaccattctcctgcctcagcctcctgagtagctggactataggcccccgccaccatgcccagctacttttttgtatttttagtagagacggggtttcactgtgttagccaggattgtcttgatctcctgaccttgtgatccacctgcctcggcctcccaaagtgctgggattacagccatgagccactgcacctggcctagtccccacaaatgttaatgcatcccggcattaacccaaaagtccaagtccgaagttttatctgagaagggactcaaggcaagttccttttgcctatgagtctgtaaaatgaaaagcaagttagttacttcctaaatataatgggggacagggattgggcaaatacactcattccaaatgggagaaattcagccaaaacaaaggagccacagaccatatacaagtccgcaatccaatagggcaatcattaaaccttaaagttccctaacaatattctttgactccatatctcacatccagttcatgctgatgcaaaagtggcctcccatggccttgggaagctctgcccctgtgtcttcacagggtacagcaccctcccagctactttcacaggatggtgttgagtgtctgtggcttttccaggagcatggtgaaagctgttggtggatctaacattccatggtctggaaaacagtggccctcttctcaatgttcctctaggcagtgccccagtgggggaatctgtgtgggggtcacatgacacattttccttctgcactgccctagcagaagttctccttttgggctgtgtccctgcagcaaacttctgctggatatccaaaggtttccatacatcctctgaaatgtaggcagaggtccccaaacctcaattcttgtcttctgcacacctgcaggcctaacaccacatggaagccaccagggcttggggcttgcaccctctgaaacattgaactgagctgtatattggccccttttagccacagctggagcagctgggacgaagggcaccaagtccctaggctgcacacagcaggggggccctgaatcctgcccaggaaaccatttccccctcctaggcatccaaacctgtgatgggaagatctcttacatgccctggaggcattttccccattgtcttggtgattagcatttggcttctcattacgtatgcaagtttatgcagctggctacaattcctctccagaaaatgggatttttctattgcatcatcaggcttcaaaatttccaaagttttgtggtctgcttcctcttgaatgcttggctacttagaaatttcttacaccagataccctaaatcatctctctcaaggtcaaagttccacagatctctagggcaggggcaaaatgctgccaatctctttgctaaagcatagcaagagtcacctttattcacgttcccaacaagttttttatctccatctaagaccacctcagcctggactttattgtgcatatcactgtcagcattttggtcaaacccattcaatgagtctctagaaagttccaaacgttatcacatcttcctgtcttcttctaagccctccaaggtgttccaacctctgtctgttacccagacagttccaaagttgcttccacatgtttgggtatgtttacagcagtgccgcactatctccatacaatttactatattagctcattctcatgatgctatgagactgagtaatttataaagaaaagaggtttaattgactcacagttccacatgactggggaggcctcaggaaacttacaatcatggcagaaagcagctcttcacggggcaggaggagagagaatgactgccagcagtggaaatgaatgcccgatgcttataaaacttccagatatcctgagactcactcagtatcataagaacagcatgggggaaaccacccccatgatttgattacctccacctggtcctgcccttgacacttggggattattactattcaaggtaagatttgtgtggggacacagagccagaccttattactgggactccagtactatgttgaatcagactggtgagcataggcatctttgtcttgttccagttcttagaatactttcaacttttctccagtcagtatgatactggttgtgggtttgtcataatggttctcattgttttgaggtattttccttttacagaaccttagttcattgagctcttttatcatgaagggaagttggattttttttaaacgcattttctgcatgtgttgagatgattatatgatttttgtttttaatttggattgtgtaatatatcttatttatgtatttatgtatttctttatttaaagacagtgttttgctctctcattcaagctggagagcagtggtgcaattatagctcactgcagctgcaaactcctgggctcaagtgattctcccacctcagcctctggagtagctgggactactgacatgttccaccatgcctggctaatgtgtttttttttttattttattttttgtagaggtagttgtcttactatgttgcctaggctgacctggaatttctgacctcaagcccttctttcaacttcgtgtcccaaagtgctgagattatcacatttattgatttgtatatatagattcatccttacattcctagtataaaacacacttgatcattatatattatctttttgatgtgttattgacttaatttattaatattttgttgaggatatttgtgtctatgcttttcaaggatattggcctgtagtttccttttattgttgtgttgtcctctggttttgttatcaggatgttactggcctcatagcattatttagggataatttcctcctcctcaactttttgtaacaatttcaggatgattggtgttagtagaatttggctgtgaatacacctgatcatgggctttattttgtttgatggttatttgtattaatgattcaatcccgctactcattattgttctgctcaggttttatatttcttcttggttcaatcttgagaaaatgtaagtttctaggaatttatccatttcctctaagttttcaagtatgcaagcttttacttcttcatagtagtctctgatgatctttcatttttctgtggaatcaattgtaatgtctcctttttatttatgatttttatttgtatcttttgttagtctagctaatgggttatcaattttgtttatgttttcaaagagctaatttctcatgttggtttttcatactttttcattatttatttcatttagttctgctccgatatttattccttctgctaatttttttttttttgcttttttgcttttcttgctccttgaggtgtgttgttaggttgataatttgtaagctttctacatgtttgaagtaggcagttaacggtataaacttccctcttagcacaatttttgtatgtctcattggttttgatatgtagtggttccattttcatttgttttaagaaatttctagatttccttcttaatttcttccttaagccaatgattgctcaagagcatgttgtttaatttccatatatttgtagtttccttagttttccttttcagtgatttttagttttattccattgtggtctgagaagatgctggatatgaatttgaattttaaaaatgtgttgatatttgttctgtggccaagtatgtggtctatcttggagactgttccatgtgctgaagagaagaaggaatattctgtagttgttagatagaatattctatagatggttctcccatgttgagtgcttatatttttagaatcatgatatcctcttgctgaattgatcattttatcaatagcacttgagttgtcttttttttttactgtttttgatttaaagtctgttgtatctgatataaatatagctactcctgctggcttttgattttcatttgcatgaaatatcttttttttcacccctttgattctgtatttgtttttaaaggaaagtttcttgttaccagcataaagttggatcatgttttttaatgtatttcacccatctatgtcttaagtgtagcatttaatctacttacattccaggttattgttgacatgtgaagttttgtgcctgtcatgttttttattccttttaattggttttataaattatttgctttttccttattctctatgtttctttatgatttgatggaattccatcatgttgtcatttgattattgctctttctcctttgtatgactgttttgtaagtcttgtgagttttatacttccacatgttttcgtgatggcgaatagtgaacttttgtttccatgtttaaaactcttttgaacatttaatgtatgatcagtatggtggggaggaattatcagtgtttgcttgtctgggaaatcttttatttctccttaacttatgaagcttcctcttgtggataaaaaatgcttgtctggcagttttttcttcttttagcactttgaaaatgtcatacaattctcttctggcctgtaacatttcagctgagaattccactgtctgatgggtgttcctttatagacgactagatgtttttctctttctgattttaaaattatttatttcctgttgattttagttattttgactagaatatggtgtggtgaagtcctttttgcaatgtatattcttggagattgctaattctcctttagatgtctgacactcttgctagaaatgcaaaatccccataaattactccctcatataggttttctcgacttttggttctttcttccccctcggaaacacagataattcttaagtttggttgctttatgtacttcaaaatgtgctctagtctttattcattcttttaattatttttttgactgactggattatttccaaagactggtcttcatgttatgagacttttccttctgcttggtcttgtctatcactgaaatattcaaatgtactttatatatccttcaatgaacttttcggttctggaatttctattaaaaaaaaaaaacaatatctgtcttcttggtaaatttcgcatttatgtcctgaattgattctccaatttatttgcatttgttttcagatttctctttcatgtgattgagcttctctaaaattaacattttgaatattttatctgtcattcagtaatttcattttgattcatttcttttcctgaacaattttttatggttttattgtgtcatatttccttgcttttcatgtttcctggtgtaacagtagctttttccaagtttttgaaattgcttttatacaggaggatttttgctgaaaatgtatatatgttattggttgagtcggatactttggctttgactttgggtgcccatggtagtgtaatctatacatttttttctgtaatacacagggtcattggtatctgtgatttcctccgtggttagggtacagttatttgttaaggctgtgctgaaattttgctggggactgggatgccagatggaccattcttcaggctctagtggtggcatcaataggctgtgtctgcctgttcttagtccccagagcagcttacataggcaccagtgttgatgagtcctgaagggccagttcgtgggcctccaggtagcttgttcggatgctggtagtggcagtggtgggccatgcatttgggcaggttcccagggcccctggactgctggtgtggtgtgactgaatgcagtagtgatgatggagcaactcacttgaaatcaagtggttcatgctcgtgttgctggtgcctgcaattggttgtggaggctagttcccctggcctgctggtagcacatgtgggtgggtatcatcagttgtggtattggtagattgggtcagtatgacttcagactctggcagcaccaatcaaatgccagcaataataatctaggctgggaaacttcctgggtcctgcatggcatgcttgagtgttggggatatgggtctaggcaagcagacttttccttgaaggtaatgacttcaggtgctggctgtgataagcaaaagtggggttgtcctcatgacaccagtggaattctcaggaatggactgtcatggctatgctgtatacctgccatcagggagggtggggcccctcatagcgggagcaccatgcgcaggtagctctggaaagtacagcctgtccacatctttgtctcacagaagcggtagcaggggagtgggaattgttttaggagtgcgtggaattgtccagtctcctccctcttcagccaggtggcagatgcagcagagtcagcccaaactctgtccattggtggggcacagcccagtgttacactctcaaaattgcaccaggtgtgggcccataaccagagagagtggtgcacctctcaggtgagcagcatggataagaagctgtagaaagtgaagtctgcttatgcctcaatcttgcagcagcctcaagcagggtggcggagattgtcctaggggtgtgtgggagcattcagtttcccagatccttcctcagtccaatgttggcaatggcagcagccttgtcagtgctgccttggggcaggatctagatccttggtatctaggctctcagaatggttccaggttgaagctgctctgagattggatgcctgtgggattttgggtgggttccctgtctggagcaacacctctgcacaatcactagcaatgacctgtgttaggcccaaggcctgtggtgattgatgggttcttctataagccaagattgctaaagtctgttgcaggagtgtggagtcctgggagcttctccgttactttttccccatgtccaggagcttttcttggtccccagccagcccccatcctggtaagctgcttcaaaccctctcattacttgtttttggggtttccatcagtctctgctgaattttagttttctcttttagaaagtctgtttgaaatgtgaatatctactcactgttctttaaattttatgatcctagcagttttacataataaaacaaatatttaaatttgtataactcattattttacaaaatatcttagttgaagtcaccaggtcttttatatcatctttaccatttaggtaaactgtgtttccaaatatgcattatcagaatatttaacatttaattattagaagtaagtgtcttcattatgaaatttgatttccatctgacaaatccactatgaattaagaaaagtcacaatggcctttcccaaaacctctttgttgtgtatagtataatagatttaaaacatacctacagaaaaacaatatgcaaaatttgaaagatgcagtatgagactagggcacattataaaaagggtccaaaaaatgtgtttagttatataaaacttgtgaaaatttacagaaagagctatcaaattattttgatatgtttaaattactcttactgtcatgtttttttttctttcagatcaaaattacattttgatatagtttggatatttgtcctcacccaaatctcatgttgaaatctaatccacaatgttggagccagggcctggtggaaggtgtttggatcatgagggtggatcccccatgaatggcttggggcatctctgtgctgaaaactgagctctcactctgagttgacacaagatctagttgtttaaaagggtgtggcacgtgccccatcacattctcttgctcctgctccggtcatgtgatgtgcctgcccccacttcaccagctgccataagtaaaatcttcctgaggcctccccaaagcagatgccagtgatatgcttcctgcacagcctgcagacccatgagccaattaaactttttttcttataggttaaccattgtcaggtatttgtttatagcgacgcaagaaaggcctaatacagaaaactggtactgagggataaaacattgttgtaaagatacctgaaaatgtgaagctgactttagaactgggtaatgggcagaggttggaagaatttggagggctcaaaataagacagaaaaatgaggaaaagtttggaacttgttagagactgattaaatggtagtgaccaaaatgctgatggtgatatggacagtgaaatctaggctgctgagatctcagatagcagtgaggaatttatttggaactggagcaaagttcacatgtgttataccttagcaaagatcctgggttgcatccgattcatgccctagggatctgtggaagtttgaacttgagagtgatgacctgagatatctggcataagaaacttctaagcatcaaagtgttcaagatgtggcctggctgcttctaacaacatatgctcttatgtggaagcaaagaaataatgaaaggttgaaagttatatttaaacaggaagcagagcattaaagtttggaaaatttgcagcctagctatgtggcaaaaaaagaaaaaagctcttttgggagagaaataaaagcagactatggagcaaccatttgctagacatatttgcatatctaaaagaaagctaagtgctaatatccaaaacaatgagacaaagacctcaaaggtatttcatagaacttcatgcagcccctcccatcacaagcctagaggcctaggagggaagaattatttcttgggccaggcccagggctctgctcccctgcacagccttgggacacagctccctgcatctcagctgctttagctccagcctcagctcagaggaccccagataatgctcttgccactactccagaggacacaagccaccatatccctcggcagcttctgtctgatgttaatactacagacacacagaatgcttgagtgaatgagacttagcagcctttgctaggtttcagaaaatgtatgagaaggcctgggtgtccaggcagaagcctgctgcaggggcagagccctcacagagaacctctactagggcagtgcagagggaaaataacggggttggagcccttacacagagtccccactggggcactgcctagtgaagctatgagaaaggggctacgggctctgagaccccagaatggtagatcccctggcagtttacaacttcagtatggaaaagccacagatgcacaacaacctgtgagagcagcacagggtctgaaccctgtaaagccacaggggcagagctgcccaaggcctcaggagtccaccacttgcattagtgttccctggagttaagggcacttgggacatggagtcaaaggagattattttcgagctttaagatttaatgactgccctgcagggttttgaacttgcgtgggacctttcttttggctgatttctctcttttggaacatgaatgtttacccaatgcctatacccctgttgtatcttggaagtaagtaatttgaattaattgattttaagtaaccaattagttttataggctcataggtggaaaggacatgctttgtctcacacgagactttggactttggacttttgagttaatgatgaaacaaaccaagacttttggggactgttggaaaggcatgattgtattttgcaatgtgaaaaggacatgagatttgggggtgtctaggggtggaatgatatagtttggatatttgttgctgctcaaatctcatattgaaatgtaatccccaatgttggaggtggtacctgatgggaggtgtttggattatgggggcaaatcccttgtgaatgtctcaggccatccccttggtgataagtgagttctcactctgagttcacatgagatctggttatttaaaaatgtgttgcacctacctccacaccctttttcctgctctagccatgtgatatgcctgctcctgcttcaacttccatgagtaaatgcttcttgaggcctccccagaagcagacacgagtgctatgcttcctgtgcatcctgcagaaccatgagccaattacatctcatttttttttataaattacccagtatcaggtatttctttatatgaatgcaagaactgcataacacatcccttttgccatatcgtttttaaaaatccctggggttaaaaaaaaaacaagctgtgatattgaaacatgttttcagtgtccttctaaacacatgccactcttctttagcttggtttatattaagctgatgcctgtgctaatgcttgtcactgatgatcataacactttgatcactaattccactggaaagtagtcttctagtatgttctttgaataataggattatatgatgcgtagaatatatcaagataataaatgactggatatacaaatcatacttatttctagcatttagcatttctaaacaaaggtcctaggagcaacttttaaaatatttctgcacttcagttttcctttctgcaaaatggatcttgctttctttatactttacttctatatttacatataaaatttatatttaaattatagtttacatctgaaaactggttagtctaatctgtaagccatgttaacttttcattttaattcaagcaagtcaatctgtcatttgctggcaggctaatttgttaacaattaattgaatcagatgaaaccactggtatctggtttaaaaaatttgttgatccattcatattttttgttttccattcattgaatcactattgtgtatcaggtagtgctcaaggtttatgatttaaatgggagagacaaataatgaacaaaataaataattatataattctcgattaagtatttagatagacaaaatgaacccatatttattcttttgaaaacatagtggagtttgcttttatgccctatgagaccagggtttctgagttataaaaagaagtgaaactacatataattatttacatgtatctaccttctcattgcttaaaattttaatactgagtgatttgttagagtgctatttttgtctcttatttttcacattcctaaaaagaaggttatgggatgtatgcaactgtgattgagtgcatacacacgaaatacatttgttttcataatgttacaagtctagttttggttgtttgagtgctcatagactcaaatgaacacagcacttggtgtacttattcatgaacttaatatttgcttagtcagataatgttgaatgttaggatgaaagaaaaatctctgatttctataatggacttatatatttactgttttcgattttattatttttgggccagcatccagtgatatgcctaaaaaccagctccccaaaaaccaaacaaatcaaaataagaagaaaactgctatttataacatttgccaattttctttgtgtaaacatttctatcgtggcagatttcaggttaccaacagcttaacaactggctcacaaaattaatgaatatttaacaattggctctagtttgagcaggtccaaggcagcaccctcctttaaaaatattgtactacatatgaaatgggtatcacttcagactcttcacggcaatcttttcttatatctattaagcaaagcaaacaacaaaaacttttccaaccagtttacttttcaataccttcaacaaagcatgacacattaactaaatatttgagaattctctataaaagtgaatgaaaaaagtttgtttaccagtttaatttataccactttaacagagaatggtattaaattggaagggagtttagcttaattgcatttggatcatttttttatcagcatgtaaatattggtaaaaaaaagaaaatgtttggtgattagaagtgtggatgcctgcaaatgtcctcaaatagtgaaagctaccacaagggaaaatacacctggctaagcctttttcattttaggtctcagaagtgatataacttgtagaagcttagattccaaagaaaatatttatggcttacatagtttgatagatttccttgccttcatggatttaaataattaacaatgcatcttagatgcataggatatatctactatagcaacactgcccgtaatggtagccactaggcatgtgtgggtattttaacttaaataaaaatataaaattcaaacttcagttaatgaattagtcacatttcaagtgctcaatagtcacatgttatttgtggctactatattagacagcacagttatagaatgttttcatcattggagaaagttccattggacagcactccattaaatagggtgaatggaaggtctagaaccatcagtcattttgagaacaagaaaggataataaagacttaaaaatcagcaagtgtcttgaaattattctttcagttacccagaaaggacagctactattgacttttggcttattgtgctattgtcttcatcactttctgttagaaaacagaattcactgatttagcaaatgttgaatgtatgcaaaatactctgttatattgctttgtccaaaacacagaaaagaaacagacatagaaaacctccacccccaaaaggatttatagaattatatgccacttctggctaaagccatcataatttgttagttaaataagatgcattcagaagcagattttattagaggtagtatggtataattgctatctgcctggatttgaatcctggttttaccactccttgttatgtgaccttaggcaaattaattaacttgcctgtgtctcagattgcctcatggtcccaatgaaatggagatgctaattgtaactacttcatagtgttaacataggcctaagtgagataaagcatgttaacacatttagagcaatgtttggcacctactaagtgcacagcatgtattagccaatattttctttatgttttacattcaataatccatatagaaatagtaataagtagaaaacaatattgtggccaaaagctagcatgagatataagtggcttcctctatgtaggttcttctgtatgttctcttatcagtaatgggacaaagggaggccccaccattaaattcacctacagttattggcctacagcattgatttacctgtgatagttgccttgatttgataccccagaataaagattatgagcctgatgggggctggagaagggtgcccaatttaatatcaaatttgacctggttggtgtttaattttaaataatatttgaatgtttacatgtgaattatttagtatagtttgcaccgtgggcacctacaatgcatatgaaaacacacatatgccttcctttcatccccaacgtggtgcgttaggcagtcaataaatatttgttgcatgagtgagtaaaagctaaaggagtcactggatattaaactttgggcagtgtttccaacataaactattattagtaatacagactttaaatccaaaagtgggaaagacattacaagttgcaaacaaatgtttcttgttgttttttgtcagtagatagtttgggaatattgctacacaaggcacatggtaaattttagttctggctcagatccctttggtgttggctcaactattagcatgtgtagctaaataactaatatagctataacatgaattggaaattgcattatgatcattaggcttgcaagactattaatccttcaattatattactgaatgtggcaaaatcatgaagacaaaaataggtaaaataccttactggtatggaattctattccctgtttgacatttaagtgtcttacagtacatttttctctatttgtgggaaactgtataatgtcagtgtgccatagttttgttctgataacacatttaagaaatttaagttggaagctgttatttggcagtttaccaacaccatctgattagctctgtttcttgtttggctgagcagctggcaattaatgaattgataggaaatggtcacacggcagtggcattagcgtgtgaacatctggtattaaaattagtcaacacagaggtttttgtgtgataattcaaattcactgacaagaatcactacttgggtctcattctaagtgctctatggaaagagaaagctattactatctcagagcatgagacgaagatacatttagtgggcattaagggttgtttgtgtttgtttgttagtttgggtgggtgggtgggtggcagagttacaagcccacaacttaacttggaaaccatgcatttttcccactgaactattcattctcccacttgaaggtattttatgctatggtcagatatggctgattcctttaatctgtaagccttttccaggacaagttcatcacattaaagagatgagagggttctttgttcagacaccacataggtcacacaaagggtgtgtgtattattttggactctcgtgcttacatattccagctgcacccccaatctggcatcatttcttatgcataatattatattatctcctctaattcgggattgaaattatgccttcaaaaccactgaagagtgaaagctgccgttatctagaatattttttctgagtggtgagtttcttaaccattcctagagaaacaaggtaagagtattgcggattcactgtttcatagactaatgaaacacatatattgtgataaattctaccctggaatagggagtttaacaattgctaaattgcataatttttcctttttaacctcaagagccctttttccattttttaagtttatgaaaactttgctatattcatcactgttaatttaaattcaatggtaaattggtgattgtagaacacagaccaatgcttgaattggttcataaagatccataaagtgtcatgcttccaatagtatttagatataccaactttcagcataaagtactccccctatttagtggtaagctacgttagtaaaaacaatgagcaaattttttattttactgtctctggttttattattaaagtctttcaagttacagtctgttctgtttctgcagaactctggtgacaacacagaagaagcatatcaattaaatatgaaatatcaagacaaatacatgcataaaatatccaacattcaaataaacttccaaaagccactcctcagtagcaaaatgccattaaatcctttaggaacacattaatagattaacatttggaaaagtaattacaatgagagttgaagtcaaactaaataaaaaaagaagacatctattacataattctactgaattcttgaaagaaatcaatataataaaatatcagaggaaattcaacgttgagacagttgtttttaaaaggcaatggaacatgtgcacatacatattaccacatggtagagatatttaacacacatatgttagtacttcataaattctgtgtatacttccatatttccaagaatgtaaaataatatattgaaatgaaataaatggcctctatgaacatggtcagagttgatactttagtgccaataaactgaatcttaagccaaattgactgtgttaaaccttataaaaaactaaattttctaaacattgtcccattctttatgaaggttcaaatgtactttcaaataatttgataaaatgggcaacatttttaaccatttgtgatatatctctaaagaaaaggaactggtatagtagaggaagggattgtatgtactaattaatagcattttccgtaacaacttattctttttaggcaaagtccttgaactatgtgagtacacatcagaatctgagttattattgaagattgtattactaattgcagggaaaaataggaattgtgagaatgtataaattttggaaatctctgtcctttgctactttggatttggagaagacttctgtggtgtttcataggagctgcagctatttttgatggggcacaaattaaatatgtgaaaagtaacagggttgtaaaagtcataaatgccacataaatgaagttatcaatgagtaaaagtgattagagttttagatttgcaagtttcctttttaaatacttattgatttgttgcaaatactgttaaccctgtatttggcaaatggtgaaggcattatcacttgtgttctcatttgtaataaaacagattaacttgctgtgaaattttaactaggctgagacacaacagtagccacctaatgaaccaaagcatattgcagttaagtagctaaatagatgcatacttattacagggctaaaaaattgatctgtttacttgcaaagaagaaattgttcatataattattcattattttaggagaacttaaacattccacttccacagagatttaaaaaaaaacacaacacctaattcttaatcaatgtacgacactgcattcatataacatggtttgcatggtgaaaaaagtctgacttctgtgctgccttagaaaaataacaatggactgaaacttgatcgaatttggtaagtacaggctacaaaatcttaaaggagaaaatttgcttcatacaaaatgttactgtcactcttaatattcaccttctaaattatgttctcaaagtttgttcattgttttacataatatgctgctgaaaatgcaaagaaggagtttcagcataaattattggagtttatatcattttatcctatgctaattttaaatatgttaggggaatccactattttttcttaatattagttaatatcaattgcatttttgttaacgttcttgatattttctgtttttataggtgctcttatgatttttatttactcataatgagcattcagtttttattaggcagagtgagcaagaccaagtttcactgtcagttggattctcttgcttttttaaaccatgaaactgtagggatcacttaaaaattgtttatttttattccagcagcatacattgctgtatatgtgattctggtttgctgttacacagtgattttccttttgtaagttttattttttcacaataactgctgcactttgtccctttccattcattcagaggtccattagagataaacatagttcattgaattacacatatttaaaggaaattttcagggttggaattcaaacacaaatagtgaatgttctgcggtttttgcacatattttggcatggaatcagtgagacacaatgatgaaaggcaaaaatggccacatatattaaattccttttatatatatacacatgcacacacatactatttcaataatatatttgaaagcattatagtttaagttgaatttcacaactgataaactacaagtctatttttaaaaagtgaaagggtatgatagaagggctgtatggatattgctgtcagtacccatatcatccctccaaaatgtgaatagaattattgggggaaaaaacttgattcttttcttctgttttgcttctgtatttctttttatttttccgtgcagacattatgtgacaagtagatattttcctgcagactaaatataaaagaaatgtatcagtattctactctgtttggaaacattgttttggaggcatgacaacagctataaagtccttaacatgtaatatacatttaaaattattgctatttaattagcatatattgtagctaatatactcaaaatctactattcatttcactaaaattgttggatgttaatgaaatgctaagcaataatgtcaaacaaaatttaaaaatatgcatactacattgatgaccgtattagtgttctattgttgctataacaaattgccacaaatttagtggtttaacacagtgcaaatttattatcttggagttctgtaggtcagaagttggacatgaggttcactaggctaaaagcaaggtgtggtcaaggtgtgctgcatttctttctataggctccagagaagaatctgttatctgttttcttttcttcttttaaaataatttcaacttttatttagatatatgggatacatgtgcaagttttttacatgaatatattatgtgatggtgaggtttaggatactaatgatcctgtcacctaggtagtgagtatagtgtctaataggtagtttttcagccctttctctctccctctctaccccctctagaagtgcccaatgtttattgttaaaggtcactcacatctctttgctcatggctcccttcttccatcttcaaagccagcaatgttgcatctctgtgacaattcctctgcagtcatgtctccctctgacccttcttttctgcctgtgtcttccacagtttagaatcctggtgatcagattgggtccactaagataatccagtataatctccctatttcatgattctcaattgcatctgcaaagtccctttggccatgtgaagtaacaaattcacaggttcctgtaattaagatgtggagtggagattttaagttggggaggtggcatcactgtgcccgctgcaatgccagacattggataatgttaactactactaatgaaataataaattttaactctcatgctattacttttgcattaaacgaacagttttttaggggggttatttgggcttctcatgcaaaatcaatgtggaaatgtacaagcacatattcgacaaattatttcttaatgttataatgattagaataatgatgtgattacagataattagacacaacatttaattgaagaaatttattatggatgaattaaatattttatagaacattctctgtgctggcatgtttatcacccagtcacatttattgcataagtgcataaaccctgcaatttggttcttttattgatcaaattaacttaatgatttggatttagtcatcaatttgtgatgcataaacatagtgaatagcttcagtgttttatagcaattttaataatcagaagtcttgagagccataataattactgcagaagtatgcaaaaatattttattaaaatacattattgaaaactacaaaaatatatggaatagtagaagaattgaccttgatagatcatagtgtaagtttgaaaaaaaacaataatggtgtactgtgactattaaaatatgtatactttttttgatatgaagttttgctcttgttgcccaggctggagtgcaatggcgtgacttcggctcactgcaatgtccacctcttgggttcaagggattcttctacatcagcctccccaatagctgggattacaggtgcctgccaccatgcctggctaattttttgtatttttagtagagacgcggtttcaccattttgatcaggctgatatcgaactcctgacctcaggtgatccacccgccttggcctcccaaagtgctgagattacatgcgtgagccaccatgcccagcctattaaaatattttgttggcagaattcaacataagttattaaggtctgagaggttataggtatctaatatacaagtatattatttctataaattttatccatgcagaaaagctcaacatgtgccaggtgccacaatttgtgagttttattccagggctctcaagtctttacatttgggagttctccttcttaatgagataggagtatcacactccaggccttgccatgaacttcacatcaatctggaaactacaataacaataaccttcaaaacacacctacactgttaatcatttatgaattttttagcagagcaaatggaaattaacttttcttgaccctttactatatgcttttttgactttttctataatttagccctcatgatattttattaatttcacaagaatcaaaaatatatttttgtttaaatatatgtatttaagaccaattattgtagatgtgtacactttcacaataagtgagaggtcaacatttcaaatgtagagactcaaccaacataaaaacttggcgcatagatgacatttccttttgtgtttccttttgtgtcaggagcggatcccagagagtccttctcctgctccttctctagaagagaatcatcgtcctgggagccagacctcttcccacaccagcagcagtgtgtccagctctccctctcagatggatcatcatttggaaagaatgggtgagtaacttttctgaaacaggtaattggaaaacattgtttctggaaattagttgttaggaaaaatagaggagagggaaaagctggggaagctgatacctccttaatataaatagctttttgaaatttggtcttttgtaattgctgaaacaatatgactaacaaaatgaaacttacattgttagaagtttgttctctggaaagatcttcctttactgtatcattcaatctcatggaagtaatatgatgaaatttttgtagagtatgggtgagttctatatgtgatacaatacgcctgacacagtcacaacatcttttgaataagggaagttaaaatatcctttaggcagttgcccatttaagagtgattaaaaagtgaatcaatataagatttgccaaaatctcaacaacttagatcacaaatatttaacaggatttcacctacatgtatttattttattttatttatttattattattatttttatactttaagttttagggtacatgtgcacaatgtgcaggttagttacatatgtatacatctgccatgctggtgtgctgcacccattaactcgtcatttagcattaggtatatctcctaatgctatccctcccccctccccccaccccacaacagtccccggagtatgatgttccccttcctgtgtacatgtgttctcatttgatttcccctacatttatatatattttgttttctcagaagccttacaccatagatgctattccagaaattggttgtgatgtggcatattgggaattttagtctagctataggtctggcactaactagctgtaacatcttgtgtatgccacttaaccaccatgagtttctttacctattatacggaaaaaacttatcaccctgcctaatgcactggattattgagcggtgaaatgaaatattatgtgaaaaaagtgccaaggaagtgtgggcaataaaaattactcttctctgtgtgacttgactttgattacttatcatttccttctatataattctactcaggtatatagaagtcgacaggtacattcagctgtaacaaattctcatttagtatatagtaattaccgatcaattgagctaggtaaaatatttgttgatcttctatacctacacagtccaatttcctatgtacccatttcctttcaggaaaatgatttttgctattcctttactcttacaagggggaagttctttaagtgaactctgaatgtttacagctcataatagcgattgctttcagcctttccaaaataatgtattttcttgggggaagagaaatttgggaggctagggaaggttttagattccagaaggatgaagactatctcttggggaaattagtccaaatctcacttagcttgtcagtattatatgttttttggagccctttagcttcatagtgagcatagcagttctcaaatctggctcccaattataatcacctatggagtttttactaatatggatgctgaggccacaagctcagagtttgattcacttggtctggaatagagcctgggcagcagtattttgttttgcttttcagcatttcttcaagagattcttatatgtagccagggttaagaaccagtggatcagaacttgaggctaatgtccctcagagagtaagtttaattcctggaagacatgacagacgtcttctagctttactcttttctacgacatagactacctggttgttactacattgtgtacaactgattctagaaagtctgagaaagaacgagagtctacaaatgagtgaccgctaatgaatttaaaaaccaaaaggacacattcttctgttggtataccattcatattgatgagggtgggaagaaggagacaaaaaggggaaagggatatatagagataattatttattgagtgctggctaaaaagcacagcacatagggaaatatataatcatatggcatgggttatgcattgttgctgtcgccatgagttagacagtagctaacatgtaatttatcagatcaccagatagtttatttgtacttcaccacagggtaaatttttctatctactaaaggtgcccataatatatagaaaaaaatatatttatgatataatagatatatcataaaagaatggacaacttacacttagaagtaaaatcaaatatatccaaagcaatgtaatatcctagaaaaaaatgttgacaatatagtttatttctaattacactggcagtaattaggctctatatgcacattccatagttgtctaagaatgataccaagattgtctataaataaataagaaggcttgagaatgtttaactctacagttaccatattttattaatagggctacataatgtttgaataaaatatgactaaagataattaaattataaactctgaaaattaacatttttctctttcaatatgttttataaagtatcataataattttcagaaagttatattatctattaattttgctatgttggcaattatacaaattcatatgtatatatttgtatatattgattatactttaaaactcacacgatcaagcagcttactgattttttcattatatgatcttcagaccaacaaaaaatctttctactgttttagaagtagaagcatataaaacttatgttagttgttattacattatattcgtcattcgtgtgacacttttctgccttttttctgggtatttcacatagaaaactactcagttacatctcttatttatagttatgatgcccaacaatagagaggaacttattgttgatcaagataatggactaaccatcaaaaaattccaaaaagataattaaggtaaaatgatttttgcttatttgatacacatataataatcagatactaactcagttaacacctgtgtgctgtatactgcatccacatttcccttagtaagaatagattcataccagatttggataaattattttaatagtagaaaacatgatgtttatctgaagattgtttatttgggaggttataaattacatatccgcctgaaatttttctgtgcatatagttggaaactttatcttaagccctcttactatgccagctcagagacatctgactccctttgtattacatatttacttttttaactatgtttaaatgattcaccatttgctggttatagttgacggttatatttgacaaaactgagttgctgtcatagaggggagctgcttccctcaatccttgaaagttattttaaaaatatgtgctaatttggacatttcagatgaaagcttagcaagttagcccatcaggtatttacctggaatactgatagatatgatctcaacctgccttttgatctgctgaggtacatgtgtcacctctgcatagtatccagttttgtcttaggagagctgttcaaggaagatagagaaagtaagaattttaaagtgatgctctcctaatatgaaaactgagtacaactttgtttgtaaggctgaaagtataagagaaaaggaaaatatataatcatatggcatgggttatgcattgttgctgtcaccatgagttagacagtagctaacatgtaatttatcagatcatcagtttattgtacttcaccacagggtaaatttttctatttactaaaggtgcccataatatatagaaaaaatatttcatgaactgaagagttaatgaagaatattttctattttctgtaaactgaacgtgcttcataattacctagatgagcattttagttggaatttgaaataatatatgattttaatttcattgatctatggttggtttccttgccacatgttttgtcttttcttagcctgacagtgaaaggctataccctctggggctccaaaatgcagatgattgatttcagaatagttgtcagaaagaaagtcaggttcatgatattaaactacccaaactcttgcacaggtaatgaaagtctagttatagttgaaacttcatttataacccagcaacaatttgttcctgagacttttttcccaccatgtcatgattatttaaaggacatcttgatagtaaagcagctttgctaggaaagtcccaagctgtacatgatgcatatgatacaatcagagctgcaaaccccataagtcaaaatggcatttgggactgtcccacgtactgcagcactcaagtatacactattgtgtcttatgaaaaatcagttcaagcattactacagatgtacagtatctgattttcataaaatatatagtagtatgcactggtatttctgaatttcttgctgtggaatggtagaatattacttgtttaactcaaataagttggtcacatatcctgatgaggacattaataagcaagagtggcatattaaactgcaccccagttatagtggaaaggtttttattaaaaaaatgggattctctatgtcaagttcttccagttacatttgtgacggtaagaaaaaaatatattttcctgaaatagagtttagttattaaaagggaatgagttaaagtagaagtgtcaacatttattaactgtgacaagtaagcagtttatacaactgtggcaaacatatgttttcacatctgctttgagtatcatcatgattttaaaaatgatttatagctctgaaaattataaaatgccagctttgctatcatgaaggaattttcagaacattaagacatacctttagagtattcatgtagcccacccttactgtatctggtaaaactggatgacattataatacatgtctcaaagtctgcatgacctgagctttcacggcattgatatccattttgactatgcctaatattgtgattttagttttgaatcaagtattttgaataaactgatcagtcaaataaagcttttgattttattttttcacagactatgtcaaataaatcgaccaaattaatcacgttatgacattgtgttatgtggtcttt
